US012605459B2

(12) United States Patent
Han

(10) Patent No.: US 12,605,459 B2
(45) **Date of Patent: *Apr. 21, 2026**

(54) PROTEIN-DRUG CONJUGATES COMPRISING CAMPTOTHECIN ANALOGS AND METHODS OF USE THEREOF

(71) Applicant: REGENERON PHARMACEUTICALS, INC., Tarrytown, NY (US)

(72) Inventor: Amy Han, Hockessin, DE (US)

(73) Assignee: REGENERON PHARMACEUTICALS, INC., Tarrytown, NY (US)

( * ) Notice: Subject to any disclaimer, the term of this patent is extended or adjusted under 35 U.S.C. 154(b) by 1014 days.

This patent is subject to a terminal disclaimer.

(21) Appl. No.: 17/373,524

(22) Filed: Jul. 12, 2021

(65) Prior Publication Data

US 2022/0072141 A1 Mar. 10, 2022

Related U.S. Application Data

(60) Provisional application No. 63/154,531, filed on Feb. 26, 2021, provisional application No. 63/051,172, filed on Jul. 13, 2020.

(51) Int. Cl.

*A61K 47/68* (2017.01)
*A61K 47/55* (2017.01)
*A61K 47/64* (2017.01)
*A61K 47/66* (2017.01)

(52) U.S. Cl.

CPC .......... *A61K 47/6889* (2017.08); *A61K 47/55* (2017.08); *A61K 47/64* (2017.08); *A61K 47/67* (2017.08); *A61K 47/68033* (2023.08); *A61K 47/68037* (2023.08)

(58) Field of Classification Search

CPC .... A61K 47/6889; A61K 47/55; A61K 47/64; A61K 47/67; A61K 47/68033; A61K 47/68037; A61K 47/6859; A61K 47/6869; A61K 31/4745; A61K 47/6879; A61P 35/00

See application file for complete search history.

(56) References Cited

U.S. PATENT DOCUMENTS

| | | | |
|---|---|---|---|
| 6,596,541 | B2 | 7/2003 | Murphy et al. |
| 2008/0171040 | A1 | 7/2008 | Ebens et al. |
| 2008/0305044 | A1 | 12/2008 | McDonagh et al. |
| 2012/0096572 | A1 | 4/2012 | Macdonald et al. |
| 2016/0215040 | A1 | 7/2016 | Kyratsous et al. |
| 2018/0134794 | A1 | 5/2018 | Babb et al. |
| 2018/0369406 | A1 | 12/2018 | Lannutti et al. |
| 2020/0345863 | A1 | 11/2020 | Viricel |
| 2022/0072141 | A1 | 3/2022 | Han |
| 2022/0112306 | A1 | 4/2022 | Andreev et al. |

FOREIGN PATENT DOCUMENTS

| | | | | |
|---|---|---|---|---|
| CN | 110974975 | A | 4/2020 | |
| EP | 2907824 | | 8/2015 | |
| WO | 2005081711 | A2 | 9/2005 | |
| WO | 2014202775 | A1 | 12/2014 | |
| WO | 2015031396 | A1 | 3/2015 | |
| WO | WO-2015115091 | A1 * | 8/2015 | ......... A61K 31/4745 |
| WO | 2015146132 | A1 | 10/2015 | |
| WO | 2015155998 | A1 | 10/2015 | |
| WO | 2016149201 | A2 | 9/2016 | |
| WO | 2016209062 | A1 | 12/2016 | |
| WO | 2017147542 | A1 | 8/2017 | |
| WO | 2018058001 | A1 | 3/2018 | |
| WO | 2018089373 | A2 | 5/2018 | |
| WO | 2018182341 | A1 | 10/2018 | |
| WO | 2018218004 | A1 | 11/2018 | |
| WO | WO-2018213082 | A1 * | 11/2018 | ............. A61K 31/16 |
| WO | 2019217591 | A1 | 11/2019 | |
| WO | 2019219891 | A1 | 11/2019 | |
| WO | 2020031936 | A1 | 2/2020 | |
| WO | 2020063676 | A1 | 4/2020 | |
| WO | 2020106780 | A1 | 5/2020 | |
| WO | 2020245229 | A1 | 12/2020 | |
| WO | 2021174113 | A1 | 9/2021 | |
| WO | 2021190581 | A1 | 9/2021 | |
| WO | 2022015656 | A1 | 1/2022 | |
| WO | 2022048883 | A1 | 3/2022 | |
| WO | 2022078260 | A1 | 4/2022 | |

(Continued)

OTHER PUBLICATIONS

Google translated WO2015115091 (Year: 2024).*

International Search Report and Written Opinion mailed Apr. 23, 2024 for International Patent Application No. PCT/US2023/ 085450 which was filed Dec. 21, 2023; Applicant: Regeneron Pharmaceuticals, Inc. (20 pages) (Year: 2023).*

International Search Report and Written Opinion issued in Application No. PCT/US2021/041304; mailed Nov. 5, 2021; 18 pages.

Anami et al.; Enzymatic conjugation using branched linkers for constructing homogeneous antibody-drug conjugates with high potency; Org. Biomol. Chem.; 15(26); 2017; 5635-42; Supporting information, 44 pages.

Hu et al.; Towards the next generation of biomedicines by site-selective conjugation; Chem. Soc. Rev.; Mar. 2016; 45, 1691-1719.

(Continued)

*Primary Examiner* — Karen A. Canella
*Assistant Examiner* — John J Skoko, III
(74) *Attorney, Agent, or Firm* — Troutman Pepper Locke LLP

(57) ABSTRACT

Described herein are protein-drug conjugates and compositions thereof that are useful, for example, for target-specific delivery of therapeutic moieties, e.g., camptothecin analogs and/or derivatives. In certain embodiments, provided are specific and efficient methods for producing protein-drug constructs (e.g., antibody-drug conjugates) utilizing a combination of transglutaminase and 1,3-cycloaddition techniques. Camptothecin analogs, antibody-drug conjugates, and compositions which comprise glutaminyl-modified antibodies and camptothecin analog payloads and are provided.

2 Claims, 19 Drawing Sheets

Specification includes a Sequence Listing.

(56) References Cited

FOREIGN PATENT DOCUMENTS

| | | | |
|---|---|---|---|
| WO | 2022204947 | A1 | 10/2022 |
| WO | 2022207699 | A1 | 10/2022 |
| WO | 2022236136 | A1 | 11/2022 |
| WO | 2022253035 | A1 | 12/2022 |
| WO | 2022262516 | A1 | 12/2022 |
| WO | 2023131219 | A1 | 7/2023 |
| WO | 2023137026 | A1 | 7/2023 |
| WO | 2023161291 | A1 | 8/2023 |
| WO | 2023237050 | A1 | 12/2023 |

OTHER PUBLICATIONS

Ogitani et al.; Bystander killing effect of DS-8201a, a novel anti-human epidermal growth factor receptor 2 antibody-drug conjugate, in tumors with human epidermal growth factor receptor 2 heterogeneity; Cancer Science; 107(7); Jun. 22, 2016; 1039-46.

Dennler, P., et al., "Transglutaminase-Based Chemo-Enzymatic Conjugation Approach Yields Homogeneous Antibody-Drug Conjugates," Bioconjugate Chemistry, 2014, vol. 25, p. 569 to 578 DOI: https://pubs.acs.org/doi/10.1021/bc400574z.

Dickgiesser, S., et al., "Site-Specific Conjugation of Native Antibodies Using Engineered Microbial Transglutaminases," Bioconjugate Chemistry, Mar. 5, 2020, vol. 31, p. 1070 to 1076 DOI: https://pubs.acs.org/doi/10.1021/acs.bioconjchem.0c00061.

Huggins Ian J. et al: "Site Selective Antibody-Oligonucleotide Conjugation via Microbial Transglutaminase," Molecules, vol. 24, No. 18, Sep. 10, 2019 (Sep. 10, 2019), pp. 3287, XP055853767, DOI: 10.3390/ molecules24183287.

Beck, S., et al: "Site-Specific DBCO Modification of DEC205 Antibody for Polymer Conjugation", Polymers, vol. 10, No. 2, Feb. 2, 2018 (Feb. 2, 2018), p. 141, XP055820725, DOI: 10.3390/ polym10020141.

Deweid Ludwig Lukas: "Arming Antibodies for Cancer Therapy: Transglutaminase-Mediated Toxin Conjugation," Ph.D thesis, Nov. 29, 2019, XP055830427, Retrieved from the Internet: URL:https://tuprints.ulb.tu-darmstadt.de/11441/1/Dissertation%20Luwig%20Lukas%20Dewe id.pdf.

International Search Report and Written Opinion mailed Jul. 3, 2023 for International Patent Application No. PCT/US23/10514, which was filed Jan. 10, 2023 and published as WO 2023/137026 on Jul. 20, 2023 (Applicant: Regeneron Pharmaceuticals, Inc.) (24 pages).

Govindan et al., "Milatuzumab-SN-38 Conjugates for the Treatment of CD74+ Cancers," Molecular Cancer Therapeutics 12(6): 968-978 (2013).

Masubuchi N., "Pharmacokinetics of DE-310, a Novel Macromolecular Carrier System for the Camptothecin Analog DX-8951f, in Tumor-Bearing Mice," Pharmazie 59(5):374-377 (2004).

International Search Report and Written Opinion mailed Apr. 23, 2024 for International Patent Application No. PCT/US2023/085450 which was filed Dec. 21, 2023; Applicant: Regeneron Pharmaceuticals, Inc. (20 pages).

* cited by examiner

| General structure | DAR | L1-B' (NH2-L1-B' can be chosen from Table 7) | |
|---|---|---|---|
| | | L1 | B' |
|  | 2 | Peptides | -N3 |
| | |  | |
| | |  | |
| | |  | |
|  | 4 |  | |
| | |  | |
| | |  | |

| General structure | group | n | L1 |
|---|---|---|---|
|  | A | 2 |  ,  |
| | B | 3 |  ,  |
| | C | 4 |  |
| | D | 6 |  |

To FIGURE 4C

From FIGURE 4B

Ab-Q295/297

Ab-8N3

Ab-(BL2-Branched-Linker-Payload)4

| D1 \ D2 | H4H13290P2 | H4H13291P2 | H4H13295P2 | H4H13300P2 | H4H13299P2 | H4H13301P2 | H4H13302P2 | H4H13306P2 | H4H13309P2 | H4H13311P2 | H4H13312P2 | H4H13313P2 | H4H13316P2 | H4H13318P2 | H4H13319P2 | H4H13325P2 | H4H13331P2 |
|---|---|---|---|---|---|---|---|---|---|---|---|---|---|---|---|---|---|
| H4H13290P2 | | 1 | 2 | 3 | 4 | 5 | 6 | 7 | 8 | 9 | 10 | 11 | 12 | 13 | 14 | 15 | 16 |
| H4H13291P2 | 17 | | 18 | 19 | 20 | 21 | 22 | 23 | 24 | 25 | 26 | 27 | 28 | 29 | 30 | 31 | 32 |
| H4H13295P2 | 33 | 34 | | 35 | 36 | 37 | 38 | 39 | 40 | 41 | 42 | 43 | 44 | 45 | 46 | 47 | 48 |
| H4H13300P2 | 49 | 50 | 51 | | 52 | 53 | 54 | 55 | 56 | 57 | 58 | 59 | 60 | 61 | 62 | 63 | 64 |
| H4H13299P2 | 65 | 66 | 67 | 68 | | 69 | 70 | 71 | 72 | 73 | 74 | 75 | 76 | 77 | 78 | 79 | 80 |
| H4H13301P2 | 81 | 82 | 83 | 84 | 85 | | 86 | 87 | 88 | 89 | 90 | 91 | 92 | 93 | 94 | 95 | 96 |
| H4H13302P2 | 97 | 98 | 99 | 100 | 101 | 102 | | 103 | 104 | 105 | 106 | 107 | 108 | 109 | 110 | 111 | 112 |
| H4H13306P2 | 113 | 114 | 115 | 116 | 117 | 118 | 119 | | 120 | 121 | 122 | 123 | 124 | 125 | 126 | 127 | 128 |
| H4H13309P2 | 129 | 130 | 131 | 132 | 133 | 134 | 135 | 136 | | 137 | 138 | 139 | 140 | 141 | 142 | 143 | 144 |
| H4H13311P2 | 145 | 146 | 147 | 148 | 149 | 150 | 151 | 152 | 153 | | 154 | 155 | 156 | 157 | 158 | 159 | 160 |
| H4H13312P2 | 161 | 162 | 163 | 164 | 165 | 166 | 167 | 168 | 169 | 170 | | 171 | 172 | 173 | 174 | 175 | 176 |
| H4H13313P2 | 177 | 178 | 179 | 180 | 181 | 182 | 183 | 184 | 185 | 186 | 187 | | 188 | 189 | 190 | 191 | 192 |
| H4H13316P2 | 193 | 194 | 195 | 196 | 197 | 198 | 199 | 200 | 201 | 202 | 203 | 204 | | 205 | 206 | 207 | 208 |
| H4H13318P2 | 209 | 210 | 211 | 212 | 213 | 214 | 215 | 216 | 217 | 218 | 219 | 220 | 221 | | 222 | 223 | 224 |
| H4H13319P2 | 225 | 226 | 227 | 228 | 229 | 230 | 231 | 232 | 233 | 234 | 235 | 236 | 237 | 238 | | 239 | 240 |
| H4H13325P2 | 241 | 242 | 243 | 244 | 245 | 246 | 247 | 248 | 249 | 250 | 251 | 252 | 253 | 254 | 255 | | 256 |
| H4H13331P2 | 257 | 258 | 259 | 260 | 261 | 262 | 263 | 264 | 265 | 266 | 267 | 268 | 269 | 270 | 271 | 272 | |

PROTEIN-DRUG CONJUGATES COMPRISING CAMPTOTHECIN ANALOGS AND METHODS OF USE THEREOF

CROSS-REFERENCE TO RELATED APPLICATIONS

This application claims priority to U.S. Provisional Application Ser. No. 63/051,172, filed on Jul. 13, 2020, and 63/154,531, filed on Feb. 26, 2021, the contents of which are incorporated herein by reference in their entirety.

FIELD OF THE DISCLOSURE

The present disclosure relates to protein-drug conjugates (e.g., antibody-drug conjugates), pharmaceutical compositions, and methods of treating disease therewith. Also provided are specific and efficient methods for producing protein-drug constructs utilizing a combination of transglutaminase and 1,3-cycloaddition techniques. More specifically, the present disclosure relates to protein-drug conjugates (e.g., antibody-drug conjugates) comprising camptothecin analogs and derivatives.

SEQUENCE LISTING

An official copy of the sequence listing is submitted concurrently with the specification via EFS-Web as a paper copy of an ASCII formatted sequence listing with a file name of 250298_000248_SL txt, and a size of about 952 kilobytes, and created on Jul. 12, 2021. The sequence listing contained in this paper copy of the ASCII formatted document is part of the specification and is herein incorporated by reference in its entirety.

BACKGROUND OF THE DISCLOSURE

Proliferative diseases are characterized by uncontrolled growth and spread of abnormal cells. If the spread is not controlled, it can result in death. Abnormal proliferation, for example, cancer, is caused by both external factors (e.g., tobacco, chemicals, radiation and infectious organisms) and internal factors (inherited mutations, immune system conditions, the mutations that occur from metabolism). These causal factors may act together or in sequence to initiate or promote abnormal proliferation. Cancer is treated by surgery, radiation, chemotherapy, hormones and immunotherapy. However, there is a need for more effective anti-proliferation drugs.

The ideal anti-proliferation therapy would enable targeted delivery of highly cytotoxic agents to tumor cells and would leave normal cells unaffected. Conventional chemotherapeutic treatment is limited because of the toxic side-effects that arise from effects of the drug on non-cancerous cells. Various approaches to targeted drug delivery have been tried, including the use of conjugates of tumor targeted probes (such as antibodies or growth factors) with toxins such as *pseudomonas* or diphtheria toxins, which arrest the synthesis of proteins and cells. However, the side effects include reaction of the immune system due to non-human components of the conjugates. Further, the half-life of the drug conjugates was limited due to elimination from the circulation through renal filtration, and schematic degradation, uptake by the reticuloendothelial system (RES), and accumulation in non-targeted organs and tissues.

Another approach uses passive drug carriers such as polymers, liposomes, and polymeric micelles to take advantage of the hyper-permeability of vascular endothelia of tumor tissue. Polymeric drugs and macromolecules accumulate within solid tumors due to an enhanced permeability and retention mechanism. However, barriers of using such targeted deliveries include fast clearance of foreign particles from the blood, and technological hindrances in obtaining highly standardized, pharmaceutically acceptable drug delivery systems with the necessary specificity and selectivity for binding tumor cells.

Protein conjugates, such as antibody conjugates, utilize the selective binding of a binding agent to deliver a payload to targets within tissues of subjects. The payload can be a therapeutic moiety that is capable of taking action at the target.

Several techniques for conjugating linkers and payloads to antibodies are available. Many conjugates are prepared by non-selective covalent linkage to cysteine or lysine residues in the antibody. This non-selective technique can result in a heterogeneous mixture of products with conjugations at different sites and with different numbers of conjugations per antibody. Thus, there is a need in the art for methods and techniques that provide site-selective antibody conjugation.

There is a need in the art for additional safe and effective anti-tumor targeting agents that can bind to various antigens to provide enhanced the treatment of diseases such as cancer for use in monotherapy and combination therapies. In certain embodiments, the present disclosure meets the needs and provides other advantages.

The foregoing discussion is presented solely to provide a better understanding of the nature of the problems confronting the art and should not be construed in any way as an admission as to prior art nor should the citation of any reference herein be construed as an admission that such reference constitutes "prior art" to the instant application.

SUMMARY OF THE DISCLOSURE

Various non-limiting aspects and embodiments of the disclosure are described below.

In one aspect, the present disclosure provides a compound having a structure according to Formula (A):

$$BA\text{-}(Gln\text{-}NH\text{-}L1\text{-}B\text{-}(\text{-}L2\text{-}(\text{-}M\text{-}Dxd)_m)_k)_n \quad \text{(A), wherein:}$$

BA is an antibody or an antigen-binding fragment thereof;

Gln is a glutamine residue;

L1 is absent or a first linker;

B is a branching unit comprising at least one adduct of group B' and group B", wherein one of the groups B' and B" is selected from $—N_3$ and

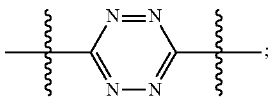 [SMILES: *c1nnc(*)nn1]

;

and the other of the groups B' and B" is selected from

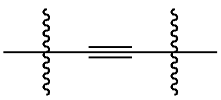

,

-continued

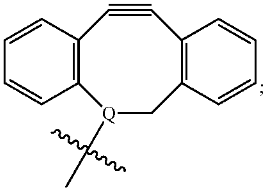

; and

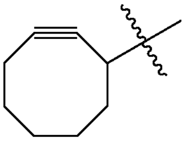

, where Q is C or N;

L2 is a second linker covalently attached to the branching unit B via the at least one group B";

M is absent or a moiety having the structure

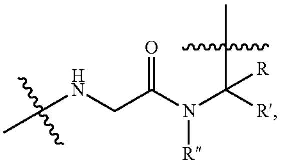

where R, R', and R" are independently at each occurrence hydrogen or a $C_1$-$C_4$ alkyl, or wherein R' and R" together form a 5-membered or a 6-membered ring;

Dxd is an anti-tumor agent having a structure according to Formula (P):

(P)

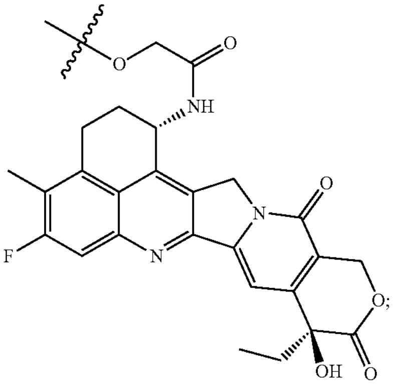

k is an integer from 1 to 12;

m is an integer from 1 to 30, and n is an integer from 1 to 30

In another aspect, the present disclosure provides a compound having a structure according to Formula (I):

$$BA\text{-}(Gln\text{-}NH\text{-}L1\text{-}B\text{-}(\text{-}L2\text{-}M\text{-}Dxd)_k)_n \quad (I),$$

wherein:

BA is an antibody or an antigen-binding fragment thereof;

Gln is a glutamine residue;

L1 is absent or a first linker;

B is a branching unit comprising at least one adduct of group B', where the group B' is selected from —$N_3$,

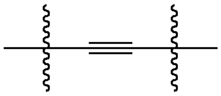

,

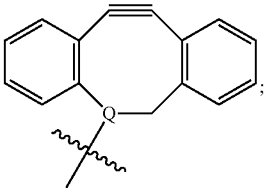

;

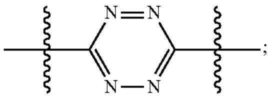

; and

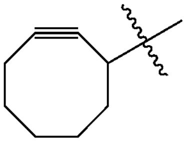

, where Q is C or N; L2 is a second linker covalently attached to the branching unit B via at least one group B", wherein the group B' and the group B" form the at least one adduct;

M is absent or a moiety having the structure

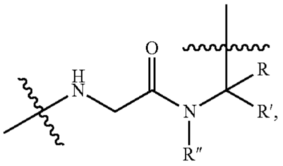

where R, R', and R" are independently at each occurrence hydrogen or a $C_1$-$C_4$ alkyl, or wherein R' and R" together form a 5-membered or a 6-membered ring;

Dxd is an anti-tumor agent having a structure according to Formula (P):

(P)

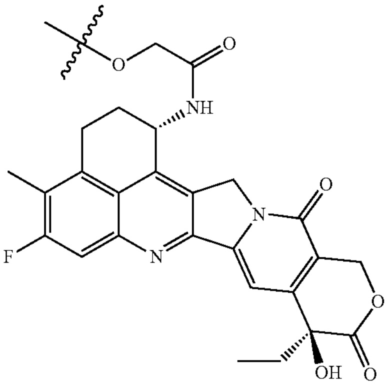

k is an integer from 1 to 12, and n is an integer from 1 to 30.

In one embodiment, the BA is an antibody or an antigen-binding fragment thereof.

In one embodiment, the BA is an anti-HER2 antibody, an anti-HER2/HER2 bispecific antibody, an anti-STEAP2 antibody, an anti-MET antibody, an anti-MET/MET bispecific antibody, an anti-EGFRVIII antibody, an anti-MUC16 antibody, an anti-PRLR antibody, an anti-PSMA antibody, an anti-FGFR2 antibody, an anti-FOLR1 antibody, or an antigen-binding fragment thereof.

In one embodiment, the BA is an anti-STEAP2 antibody comprising an HCVR/LCVR amino acid sequence pair as set forth in Table 1.

In one embodiment, the BA is an anti-HER2/HER2 bispecific antibody. In one embodiment, the BA binds two separate epitopes of HER2 protein.

In one embodiment, the anti-HER2/HER2 bispecific antibody comprises:

a first antigen-binding domain (D1); and a second antigen-binding domain (D2);

wherein D1 specifically binds a first epitope of human HER2; and wherein D2 specifically binds a second epitope of human HER2.

In one embodiment, the D1 and D2 do not compete with one another for binding to human HER2.

In one embodiment, the BA is an anti-MET/MET bispecific antibody. In one embodiment, the BA binds two separate epitopes of MET protein.

In one embodiment, the anti-MET/MET bispecific antibody comprises:

a first antigen-binding domain (D1); and a second antigen-binding domain (D2);

wherein D1 specifically binds a first epitope of human MET; and wherein D2 specifically binds a second epitope of human MET.

In one embodiment, the D1 and D2 do not compete with one another for binding to human MET.

In one embodiment, the BA is an anti-MET/MET bispecific antibody comprising an HCVR/LCVR amino acid sequence pair as set forth in Table 3.

In one embodiment, the BA is an anti-MET/MET bispecific antibody comprising a D1 antigen-binding domain and a D2 antigen-binding domain, wherein the D1 antigen binding domain comprises an HCVR/LCVR amino acid sequence pair of SEQ ID NOs: 2012/2092, or a set of heavy and light chain CDRs (HCDR1-HCDR2-HCDR3-LCDR1-LCDR2-LCDR3) comprising SEQ ID NOs: 2014-2016-2018-2094-2096-2098, and wherein the D2 antigen-binding domain comprises an HCVR/LCVR amino acid sequence pair of SEQ ID NOs: 2036/2092, or a set of heavy and light chain CDRs (HCDR1-HCDR2-HCDR3-LCDR1-LCDR2-LCDR3) comprising SEQ ID NOs: 2038-2040-2042-2094-2096-2098.

In one embodiment, the BA is an anti-MET/MET bispecific antibody H4H14639D, which comprises a D1 derived from H4H13306P2 and a D2 derived from H4H13312P2.

In one embodiment, the anti-STEAP2 comprises an HCVR/LCVR amino acid sequence pair selected from the group consisting of SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

In one embodiment, the glutamine residue Gln is naturally present in a CH2 or CH3 domain of the BA.

In one embodiment, the glutamine residue Gln is introduced to the BA by modifying one or more amino acids.

In one embodiment, the Gln is Q295 or N297Q.

In one embodiment, the BA targets a cancer selected from the group consisting of breast cancer, ovarian cancer, prostate cancer, lung cancer, liver cancer, or brain cancer.

In one embodiment, L1 comprises $C_{1-6}$ alkyl, phenyl, —NH—, —C(O)—, —$(CH_2)_u$—NH—C(O)—, —$(CH_2)_u$—C(O)—NH—, —$(CH_2$—$CH_2$—$O)_v$—, —$(CH_2)_u$—(O—$CH_2$—$CH_2)_v$—C(O)—NH—, a peptide unit comprising from 2 to 4 amino acids, or combinations thereof, each of which may be optionally substituted with one or more of —S—, —S($O_2$)—, —C(O)—, —C($O_2$)—; and $CO_2H$, wherein subscripts u and v are independently an integer from 1 to 8.

In one embodiment, L1 is selected from the group consisting of:

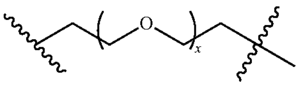
,

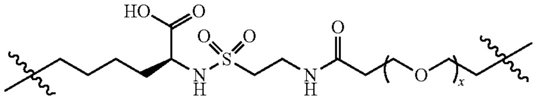
,

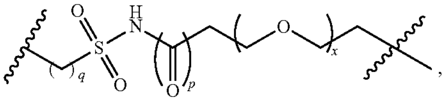
,

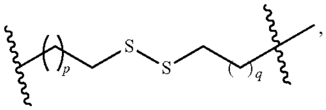
,

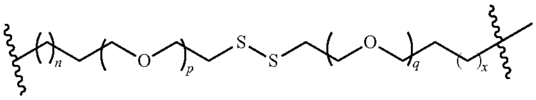
,

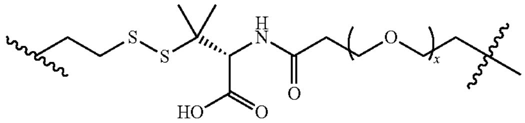
,

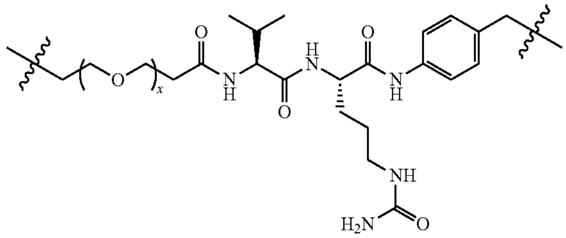
,

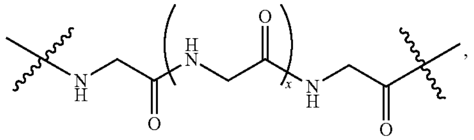
, and

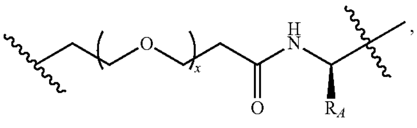
, wherein $R_A$ is a group comprising an alkyne, an azide, a tetrazine, a trans-cyclooctene, a maleimide, an amine, a ketone, an aldehyde, a carboxylic acid, an ester, a thiol, a sulfonic acid, a tosylate, a halide, a silane, a cyano group, a carbohydrate group, a biotin group, a lipid residue and wherein subscripts x, n, p and q are independently an integer from 0 to 12, and combinations thereof.

In one embodiment, B comprises one adduct of group B'.

In one embodiment, —NH-L1-B' is selected from the group consisting of:

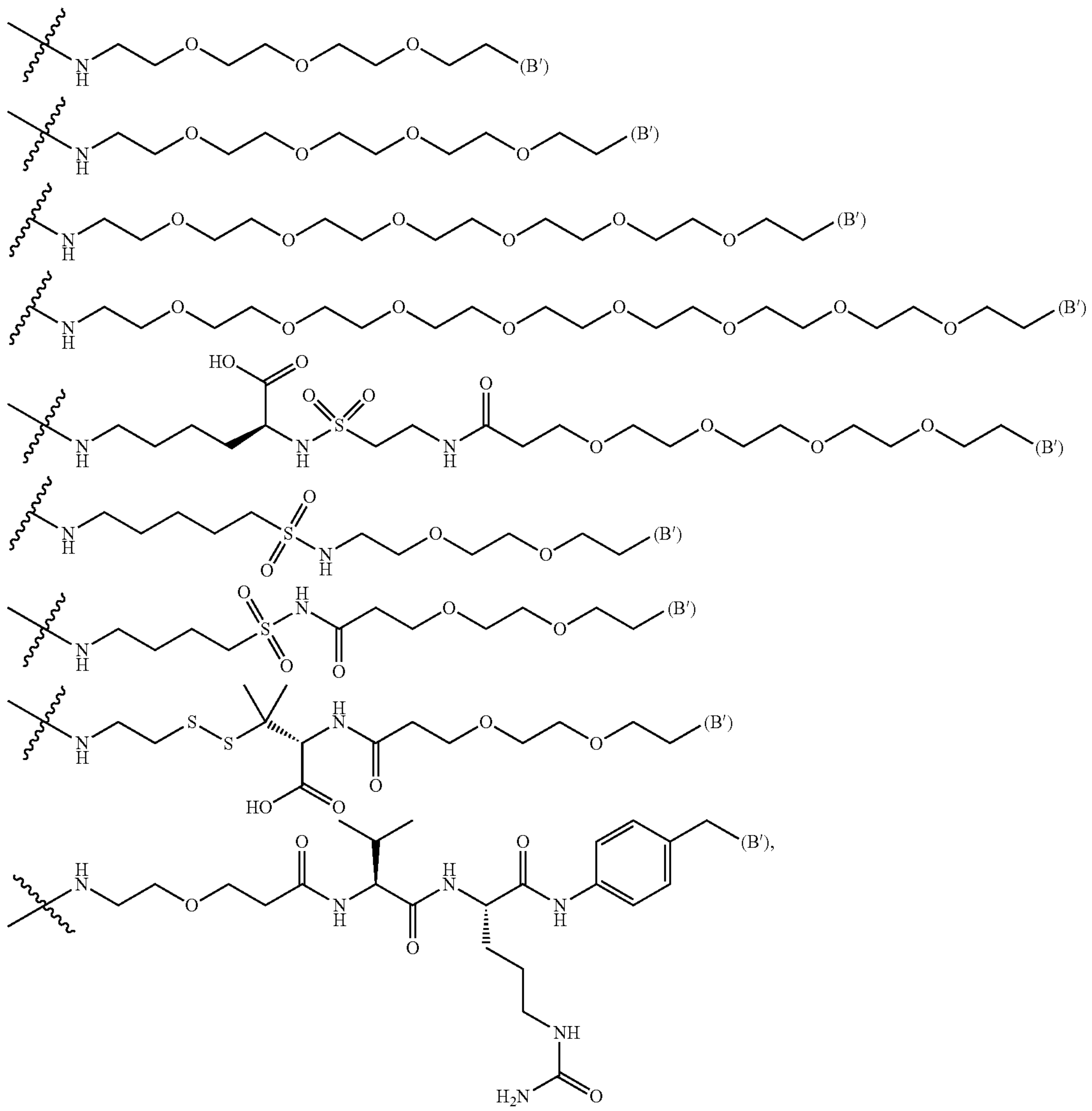

where the

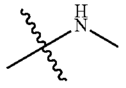 [SMILES: *NC]

is the amino point of attachment to the glutamine residue of the BA.

In one embodiment, the group B' is an azide (—$N_3$), and the adduct of the group B' comprises a triazole.

In one embodiment, B comprises two adducts of group B'.

In one embodiment, B comprises three adducts of group B'.

In one embodiment, B comprises at least four adducts of group B'.

In one embodiment, B comprises a group selected from the group consisting of:

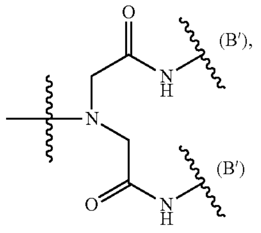

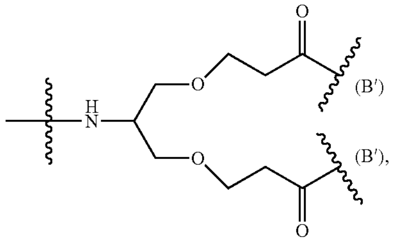

-continued
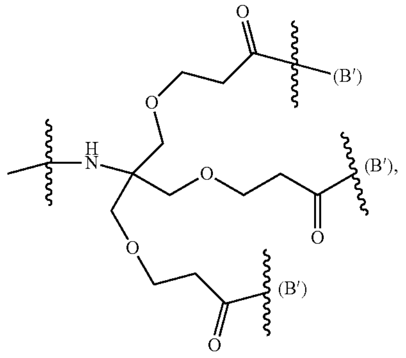
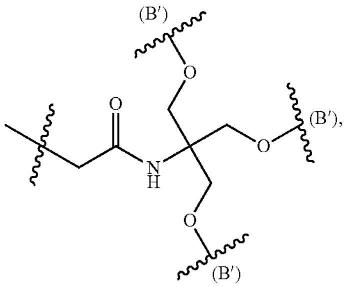
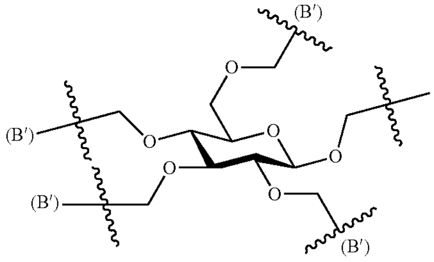
,
-continued
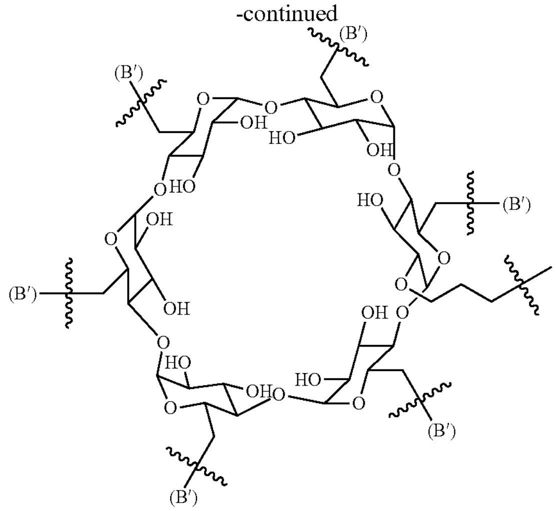
,
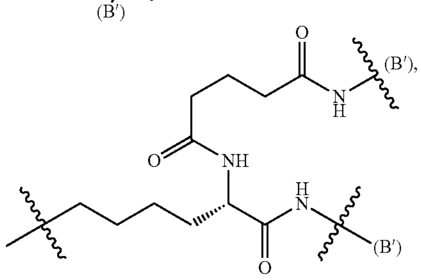
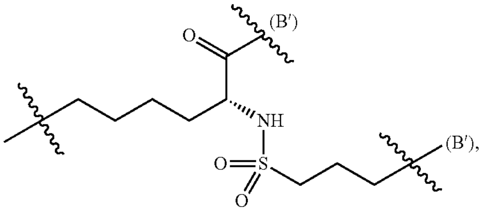
and
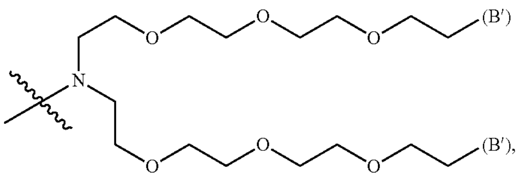
where (B') comprises points of attachment of the adduct of the group B'.
In one embodiment, B is selected from the group consisting of:
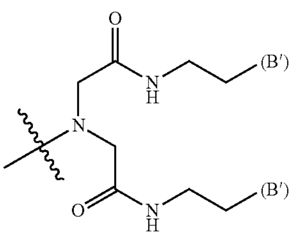
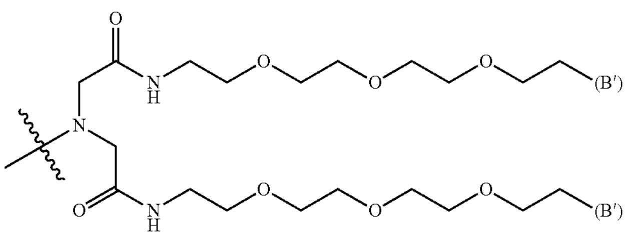

-continued
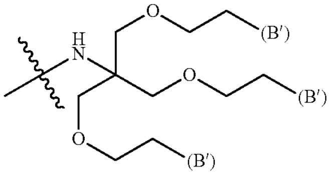
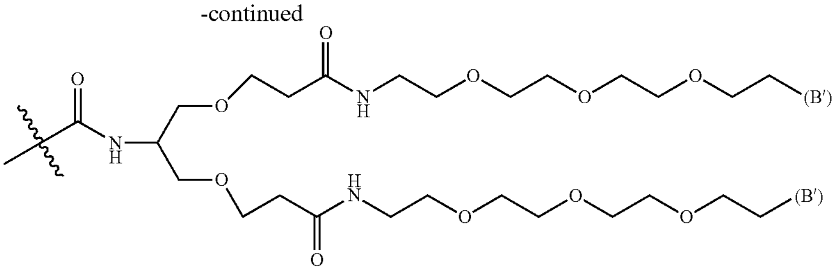
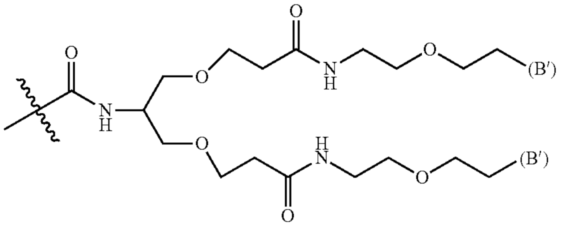
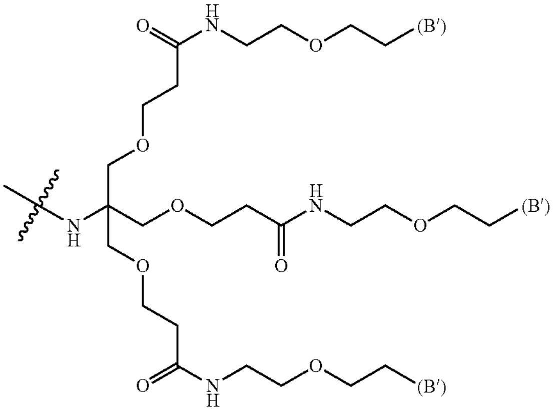
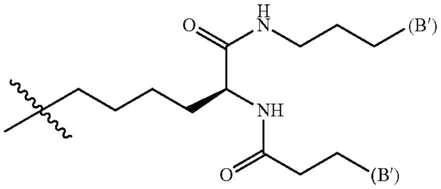
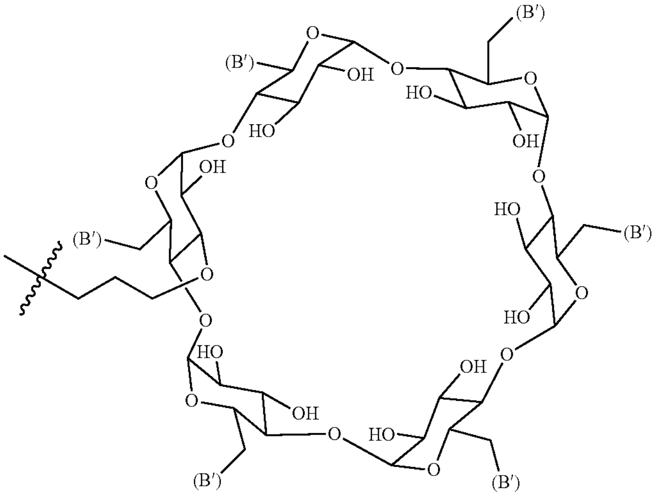
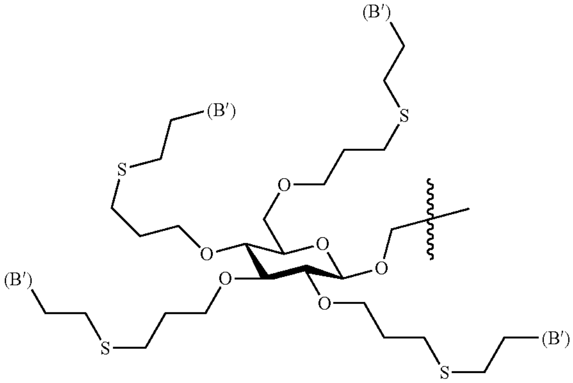
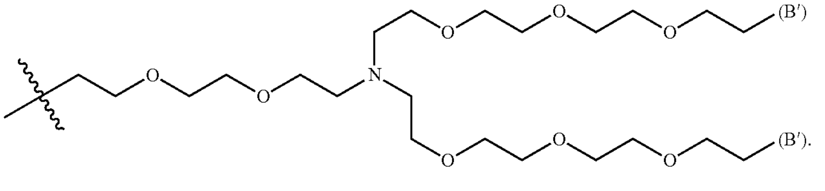

In one embodiment, —NH-L1-B is selected from the group consisting of:
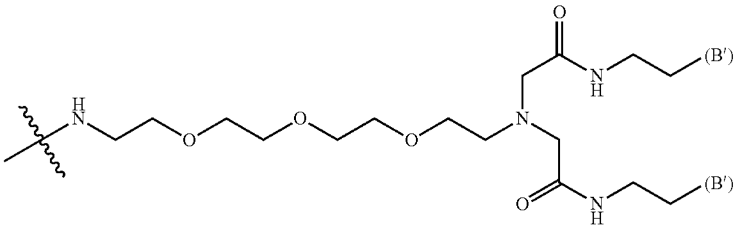
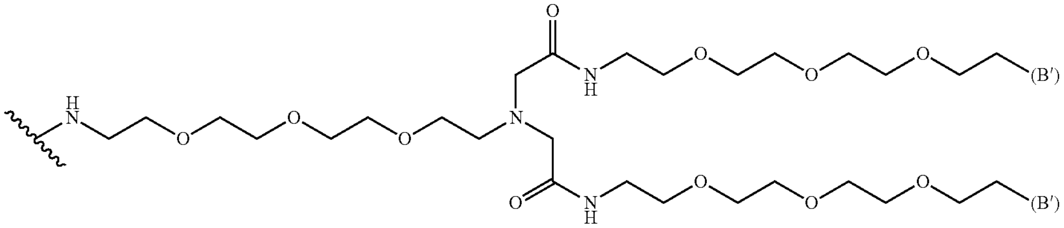
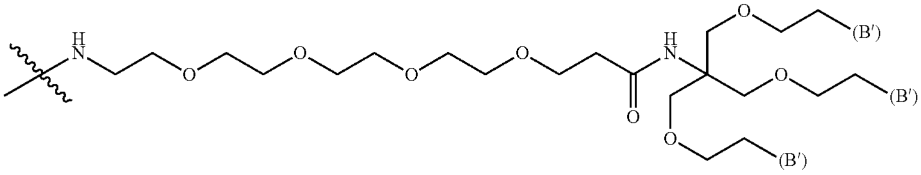
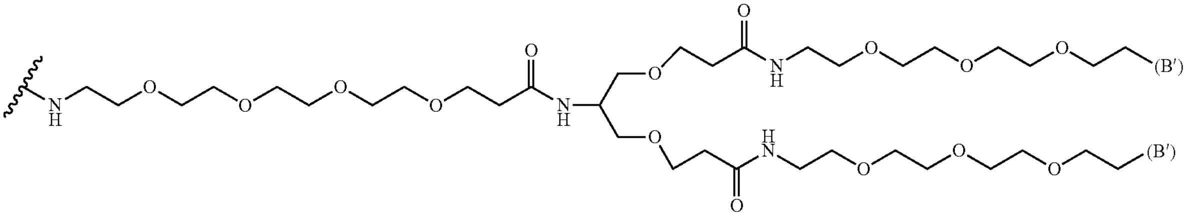
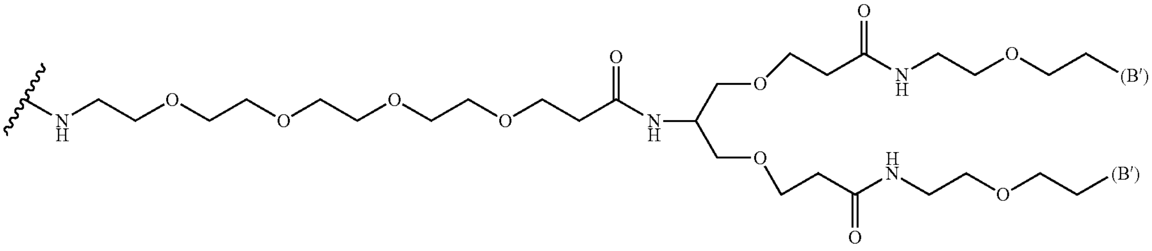
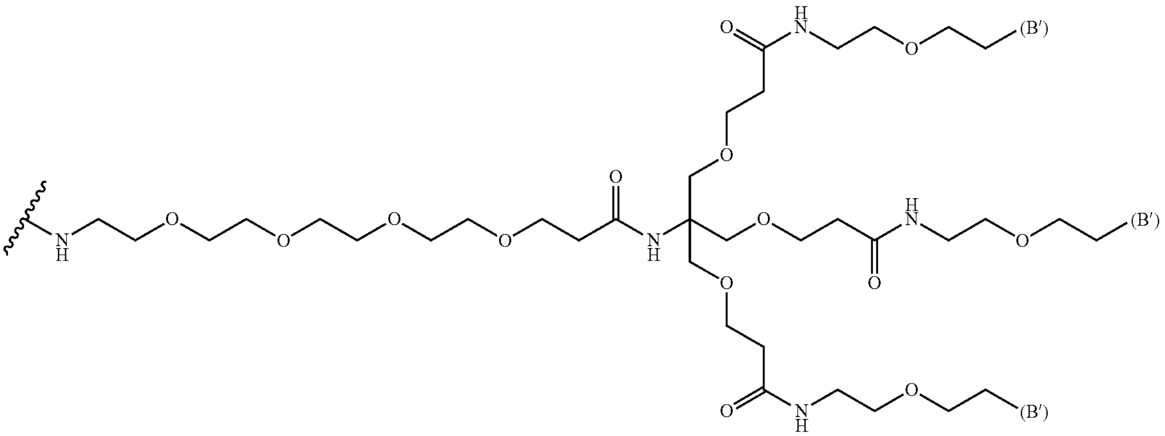

-continued
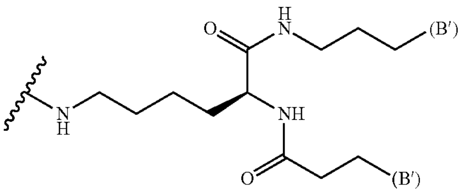
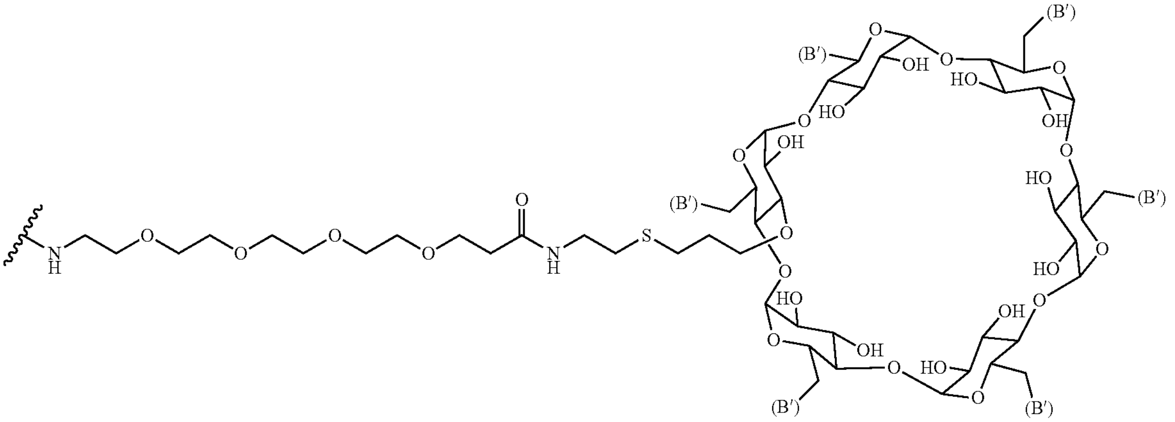
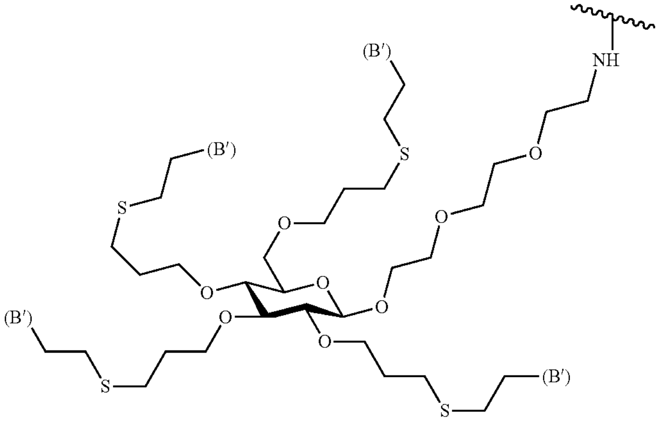
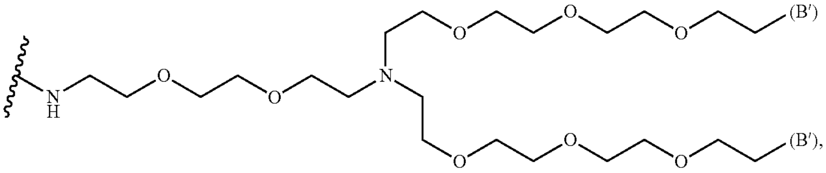
where the
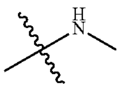 [SMILES: *NC]
is the amino point of attachment to the glutamine residue of the BA.
In one embodiment, the group B' is an azide (—$N_3$), and the adduct of the group B' comprises a triazole.
In one embodiment, the adduct of the group B' and the group B" has a structure selected from the group consisting of:
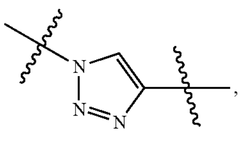
,
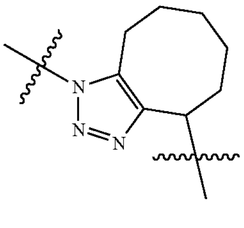
, -continued

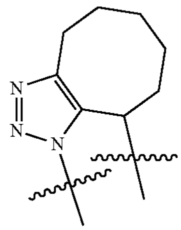, 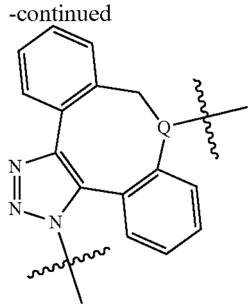, and

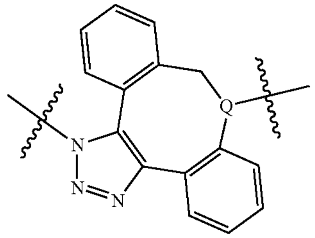, wherein Q is C or N.

In one embodiment, M is absent.

In one embodiment, M is

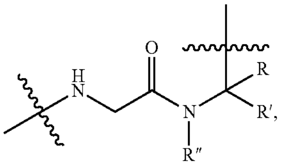

where R, R', and R" are hydrogens at each occurrence, i.e., M is

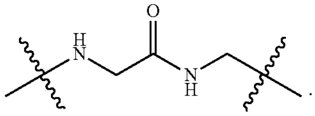 [SMILES: *CNC(=O)CN*]

In one embodiment, M is

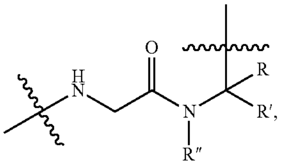

where R is hydrogen and R' and R" together form a 5-membered ring, i.e. M is

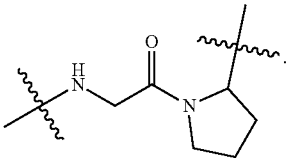 [SMILES: *NCC(=O)N1CCCC1*]

In one embodiment, n is 2. In one embodiment, n is 4. In one embodiment, n is 8. In one embodiment, n is 12. In one embodiment, n is 16. In one embodiment, n is 24.

In one embodiment, L2 has a structure according to Formula (L2):

$$B''\text{-SP1-B2-(-SP2-AA-SP3)}_p \qquad (L2),$$

wherein:

B" is a group capable of covalently attaching to the group B';

SP1 is absent or a first spacer unit;

B2 is absent or a branching unit;

SP2 is absent or a second spacer unit;

AA is absent or a peptide unit comprising from 2 to 4 amino acids;

SP3 is absent or a third spacer unit covalently attached to the Dxd, and p is an integer from 1 to 12.

In one embodiment, the at least one group B" is selected from the group consisting of —$N_3$,

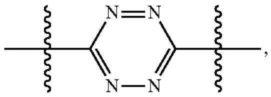, 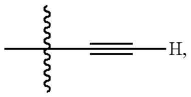

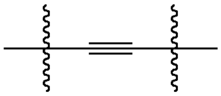,

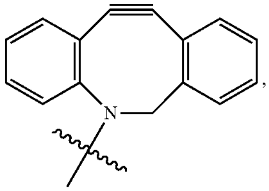, 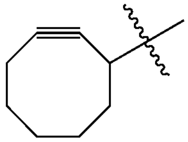, and combinations thereof.

In one embodiment, SP1 is absent or selected from the group consisting of

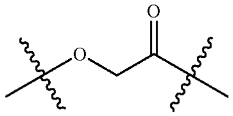 and

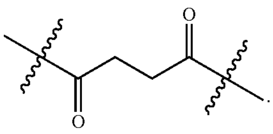

In one embodiment, the B2 is absent or selected from the group consisting of

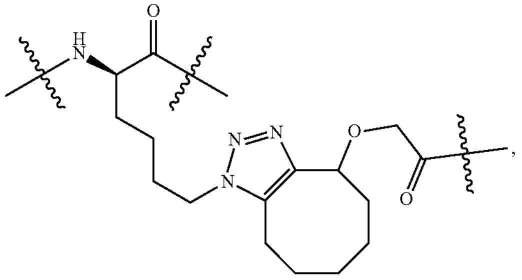

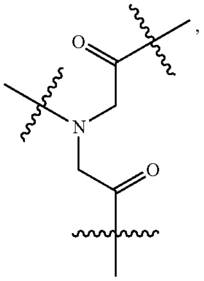

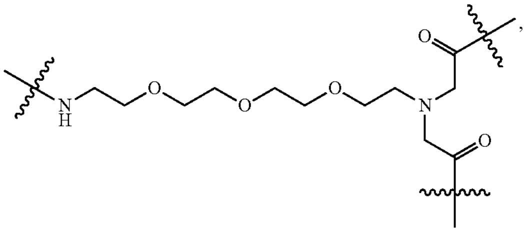

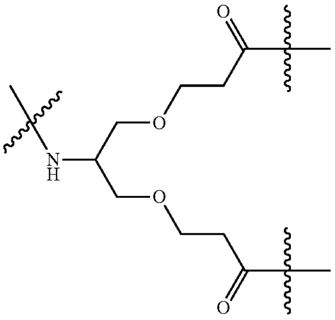

, and

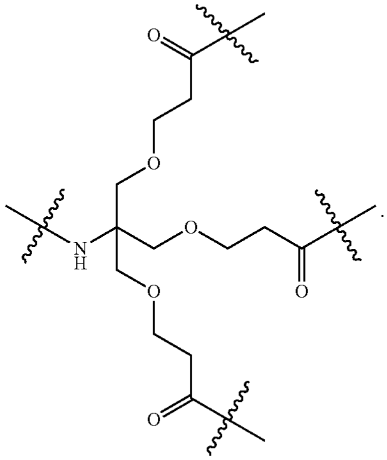

In one embodiment, SP2 is absent or selected from the group consisting of a $C_{1-6}$ alkyl, $-(CH_2-CH_2-O)_v-$, $-NH-$, $-C(O)-$, $-NH-C(O)-$, $-NH-(CH_2)_u-$, $-NH-(CH_2)_u-C(O)-$, $-NH-(CH_2-CH_2-O)_v-$, $-NH-(CH_2-CH_2-O)_v-C(O)-$, $-NH-(CH_2-CH_2-O)_v-(CH_2)_u-$, $-NH-(CH_2-CH_2-O)_v-(CH_2)_u-C(O)-$, $-(CH_2)_u-NH-C(O)-$, $-NH-(CH_2)_u-NH-C(O)-$, $-NH-(CH_2)_u-C(O)-NH-$, or combinations thereof; wherein subscripts u and v are independently an integer from 1 to 8.

In one embodiment, AA is a peptide unit comprising from 2 to 4 amino acids selected from glycine, valine, phenylalanine, proline, glutamic acid, lysine, phenylalanine, and citrulline, and combinations thereof.

In one embodiment, AA is valine-citrulline, valine-alanine, or phenylalanine-lysine.

In one embodiment, AA is selected from the group consisting of glycine-glycine-glycine (GGG), glycine-glycine-glycine-glycine (GGGG (SEQ ID NO: 2113)), glycine-glycine-phenylalanine (GGF), glycine-glycine-phenylalanine-glycine (GGFG (SEQ ID NO: 2114)), L-glutamic acid-valine-citrulline ($^{L}$EVC), and D-glutamic acid-valine-citrulline ($^{D}$EVC).

In one embodiment, SP3 is absent or selected from the group consisting of

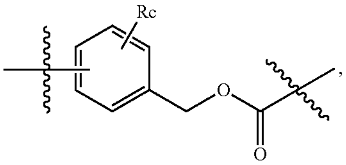

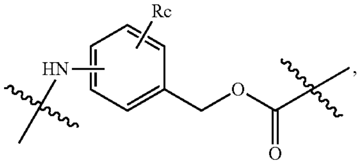

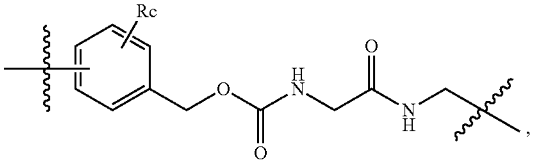

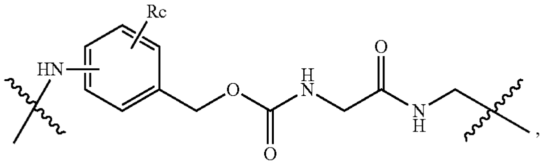

and combinations thereof, wherein $R_c$ is independently at each occurrence absent or a group selected from

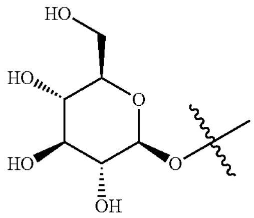

and

-continued
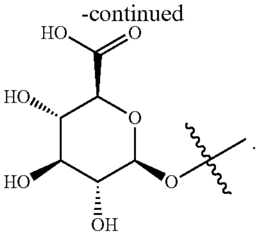
In one embodiment, the M-Dxd has a structure selected from the group consisting of
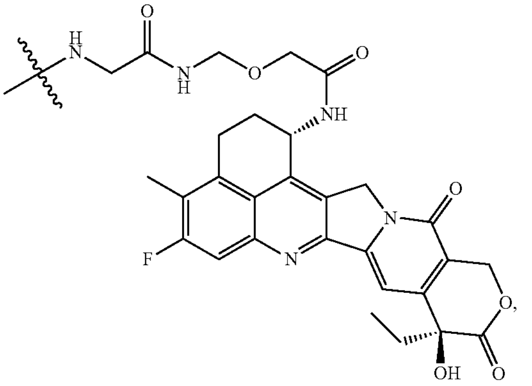
and
-continued
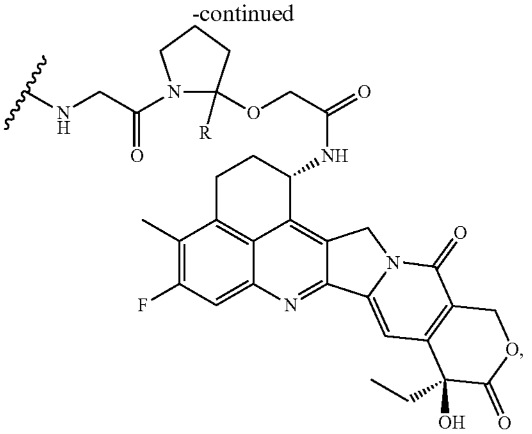
wherein R is a hydrogen or a $C_1$-$C_4$ alkyl, and where ∿∿ represents the point of attachment to L2.
In one embodiment, the compound has a structure:

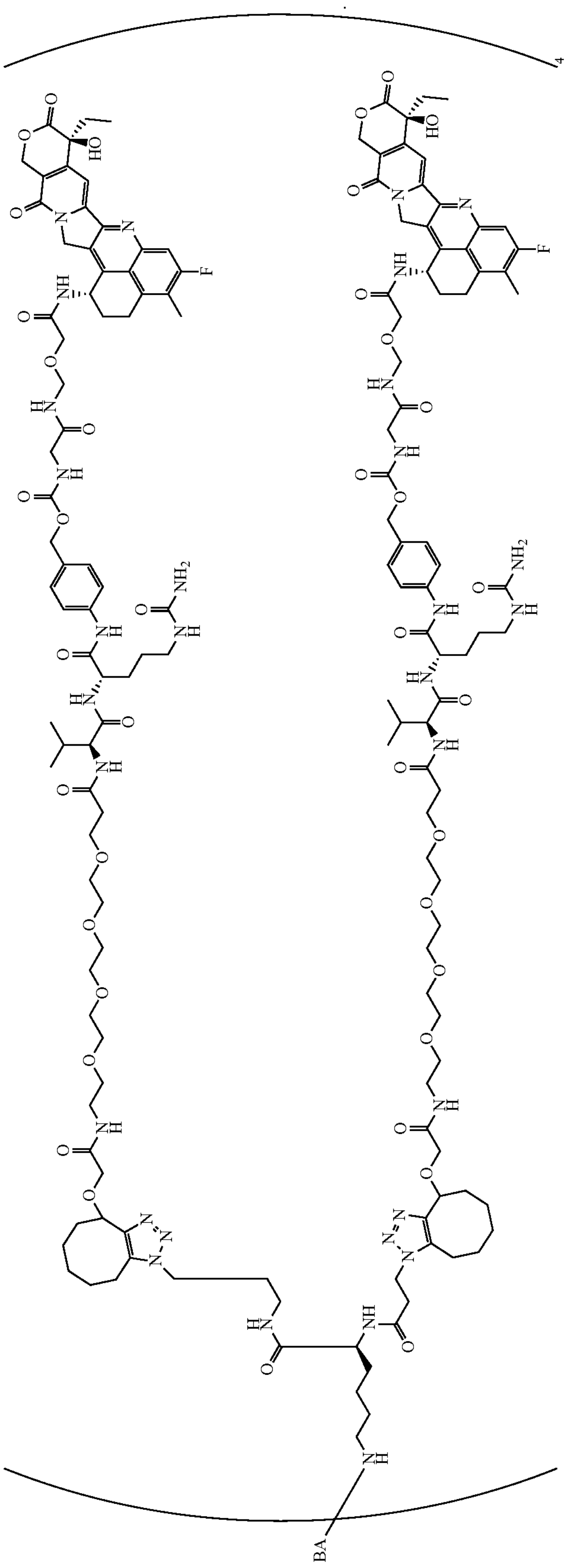

In one embodiment, the compound has a structure:

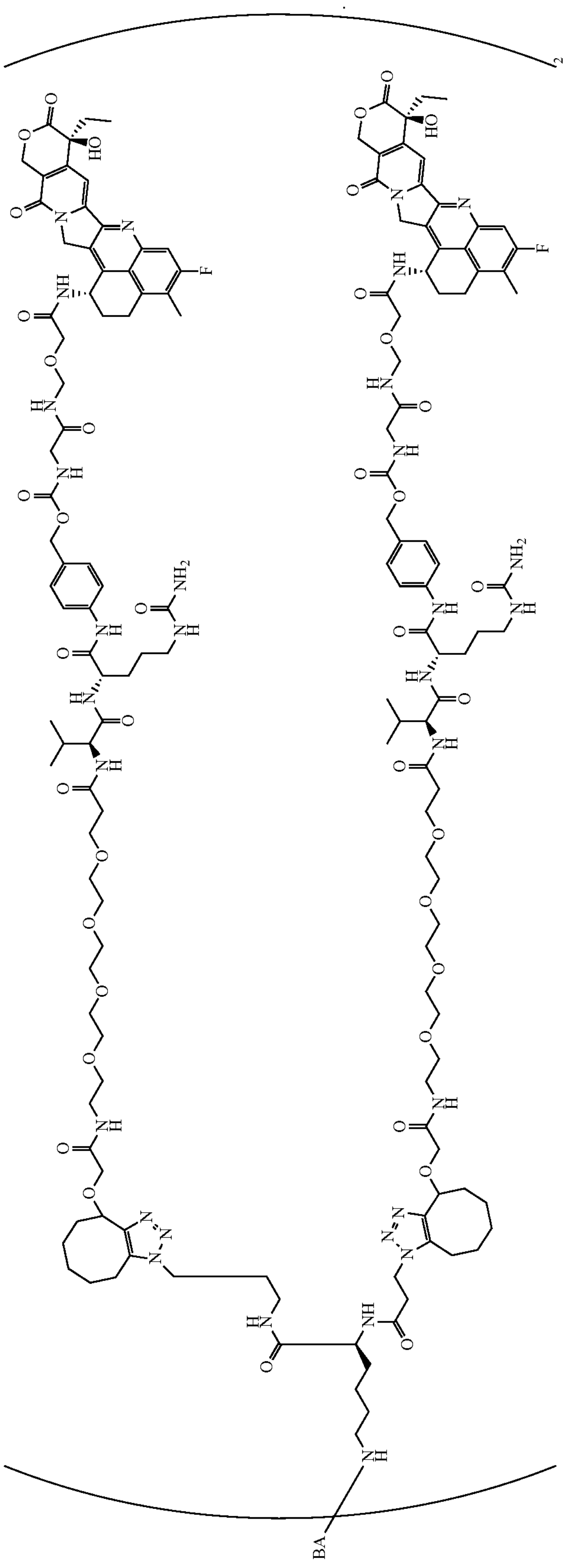

In one embodiment, the compound has a structure:

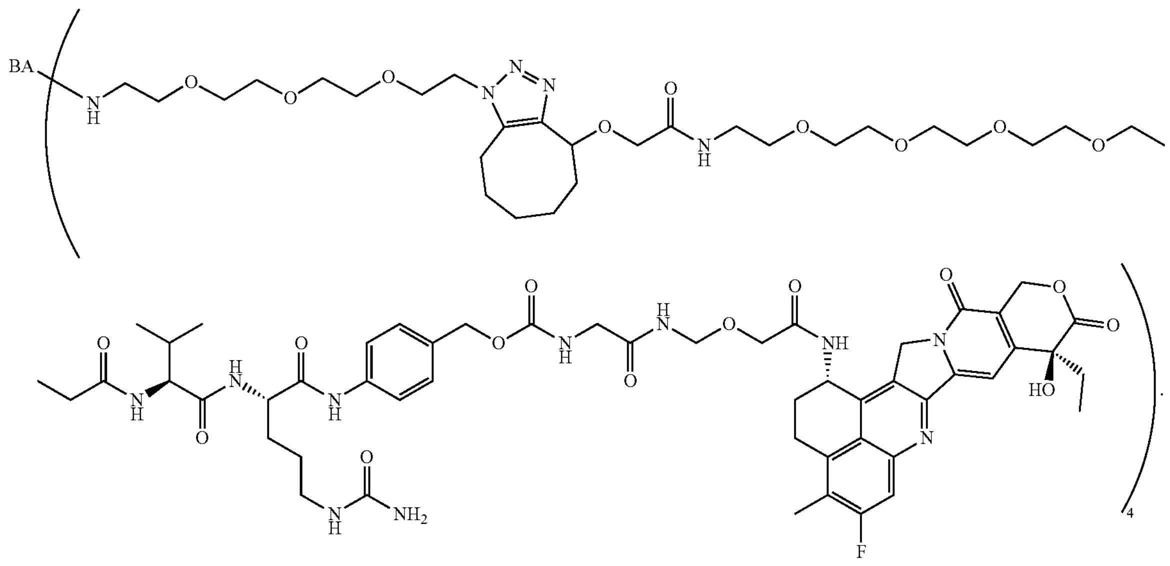

.

In another aspect, the present disclosure provides a compound having a structure according to Formula (I):

BA-(Gln-NH-L1-B-(-L2-M-Dxd)$_k$)$_n$ (I), wherein:

BA is an antibody or an antigen-binding fragment thereof;

Gln is a glutamine residue;

L1 is absent or a first linker;

B is a branching unit comprising

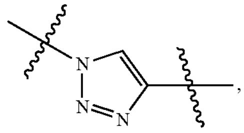

,

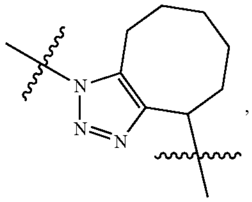

,

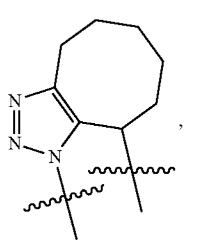

,

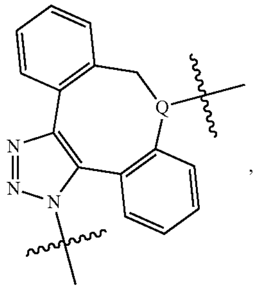

, and

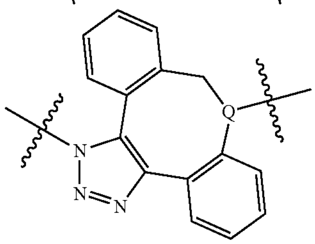

,

M is absent or a moiety having the structure

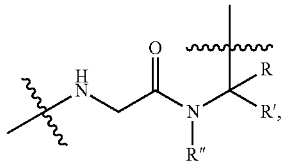

where R, R', and R" are independently at each occurrence hydrogen or a $C_1$-$C_4$ alkyl, or wherein R' and R" together form a 5-membered or a 6-membered ring;

Dxd is an anti-tumor agent having a structure according to Formula (P):

(P)

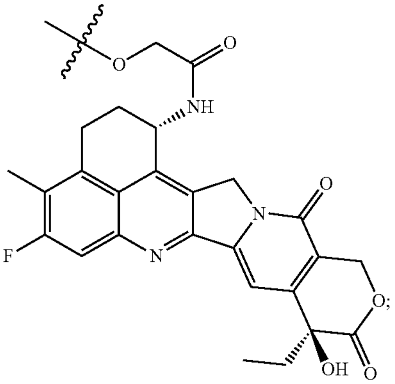

k is an integer from 1 to 12, and n is an integer from 1 to 30.

In another aspect, the present disclosure provides a compound according to Formula (L2-P), (L2'-P), or (L2"-P):

B"-SP1-B2-(-SP2-AA-SP3-M-Dxd)*p* (L2-P), $H_2$N-SP1-B2-(-SP2-AA-SP3-M-Dxd)$_p$ (L2'-P), maleimide-N-SP1-B2-(-SP2-AA-SP3-M-Dxd)$_p$ (L2"-P), wherein:

B" is selected from the group consisting of —$N_3$,

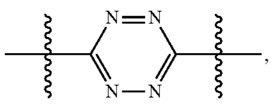

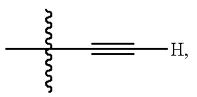

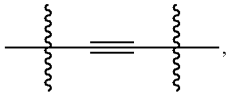

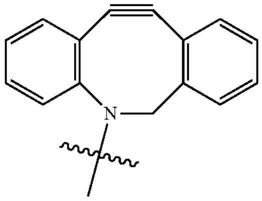

and

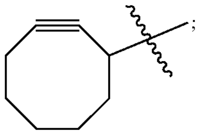

SP1 is absent or a first spacer unit selected from the group consisting of

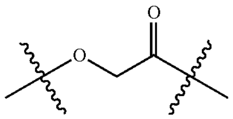

and

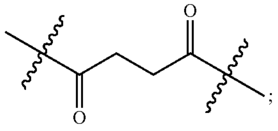

SP2 is absent or a second spacer unit selected from the group consisting of a $C_{1-6}$ alkyl, —$(CH_2—CH_2—O)_v$—, —NH—, —C(O)—, —NH—C(O)—, —NH—$(CH_2)_u$—, —NH—$(CH_2)_u$—C(O)—, —NH—$(CH_2—CH_2—O)_v$—, —NH—$(CH_2—CH_2—O)_v$—C(O)—, —NH—$(CH_2—CH_2—O)_v$—$(CH_2)_u$—, —NH—$(CH_2—CH_2—O)_v$—$(CH_2)_u$—C(O)—, —$(CH_2)_u$—NH—C(O)—, —NH—$(CH_2)_u$—NH—C(O)—, —NH—$(CH_2)_u$—C(O)—NH—, or combinations thereof;

wherein subscripts u and v are independently an integer from 1 to 8;

AA is absent or a peptide unit comprising from 2 to 4 amino acids;

SP3 is absent or a third spacer unit selected from the group consisting of,

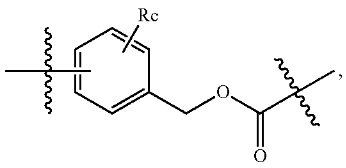

-continued

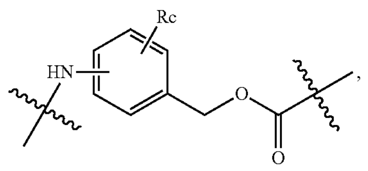

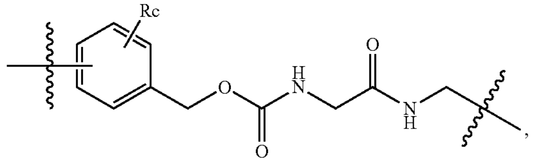

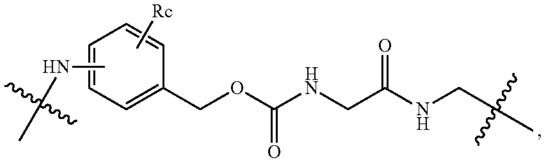

wherein $R_c$ is independently at each occurrence absent or a group selected from

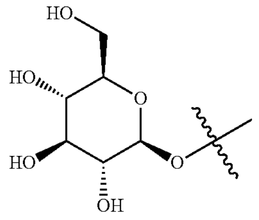

and

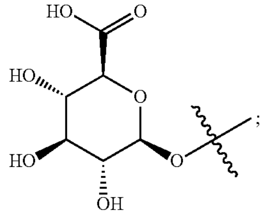

M is absent or

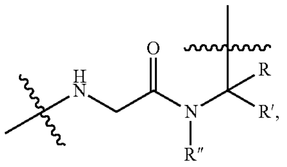

where R, R', and R" are independently at each occurrence hydrogen or a $C_1$-$C_4$ alkyl, or wherein R' and R" together form a 5-membered or a 6-membered ring; and Dxd is an anti-tumor agent having a structure according to Formula (P):

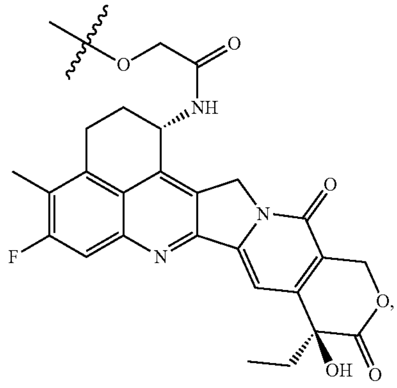

and (P) p is an integer from 1 to 12.

In one embodiment, AA is a peptide unit comprising from 2 to 4 amino acids selected from glycine, valine, phenylalanine, proline, glutamic acid, lysine, alanine and citrulline, and combinations thereof.

In one embodiment, AA is valine-citrulline, valine-alanine, or phenylalanine-lysine.

In one embodiment, AA is selected from the group consisting of glycine-glycine-glycine (GGG), glycine-glycine-glycine-glycine (GGGG (SEQ ID NO: 2113)), glycine-glycine-phenylalanine (GGF), glycine-glycine-phenylalanine-glycine (GGFG (SEQ ID NO: 2114)) and glutamic acid-valine-citrulline (EVC).

In one embodiment, the compound has a structure selected from the group consisting of:

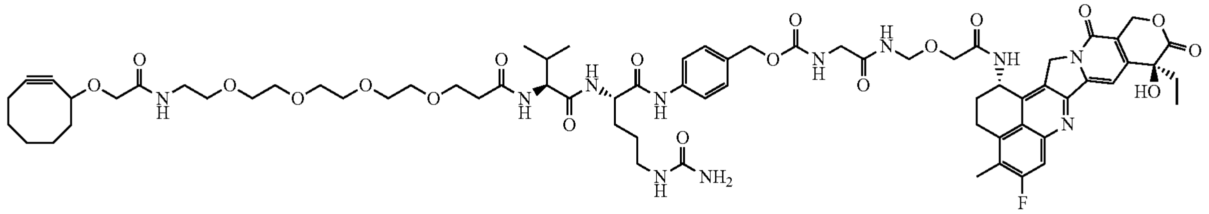

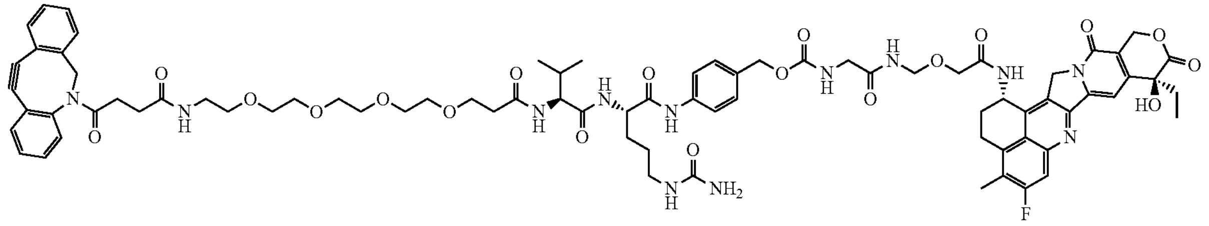

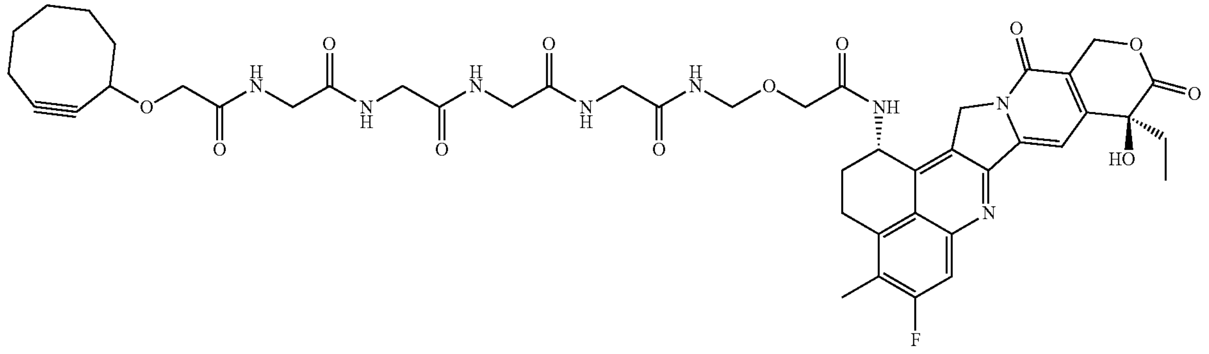

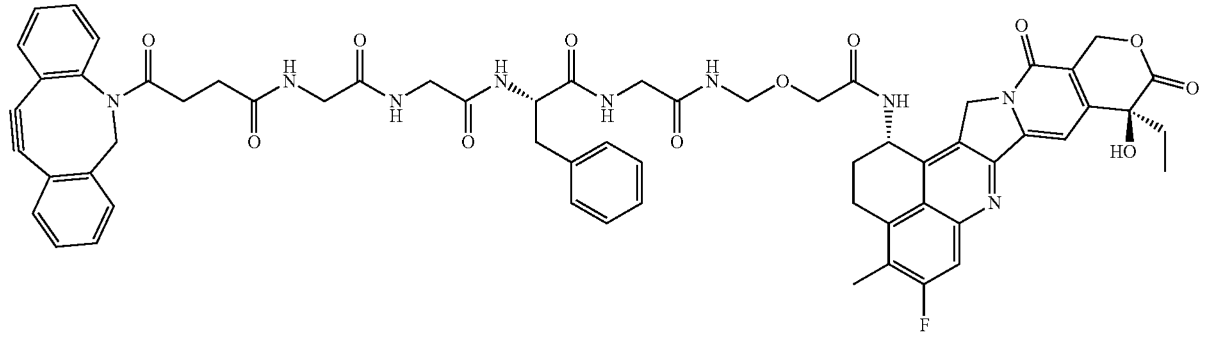

-continued
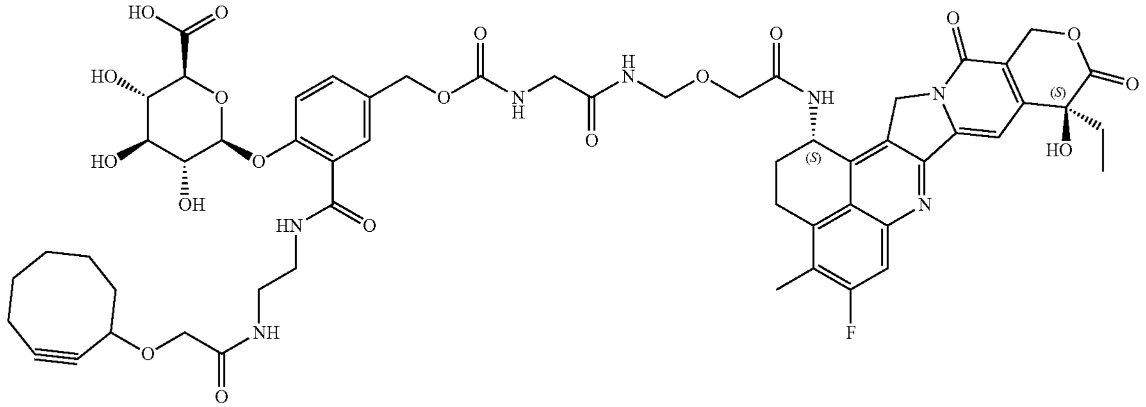
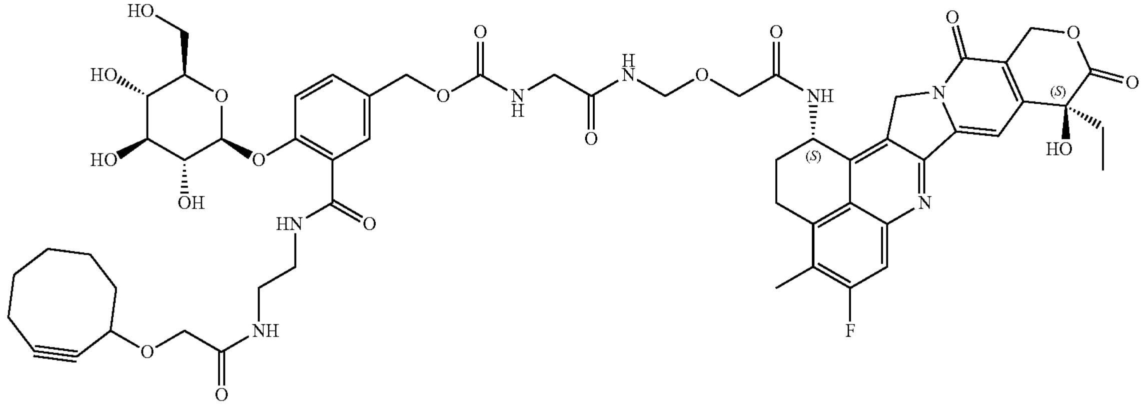
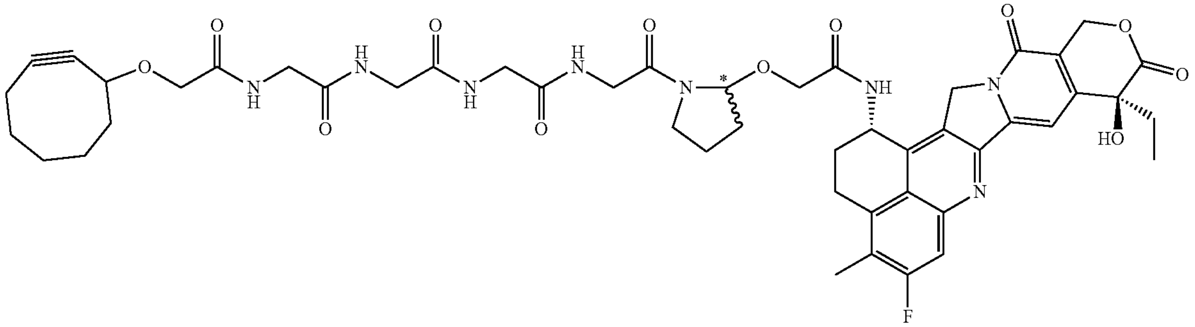
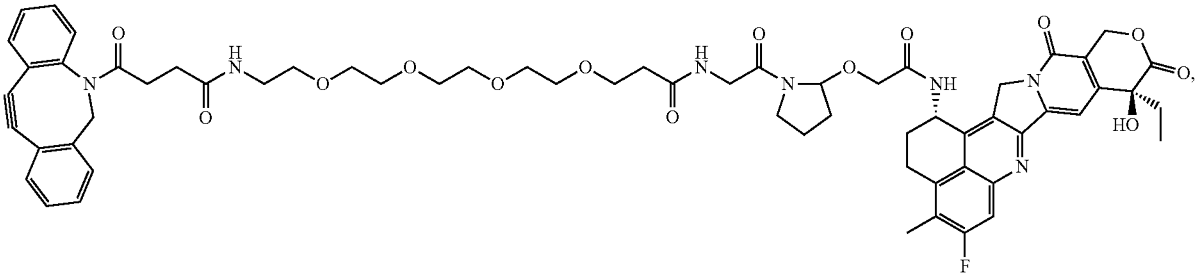
,

-continued
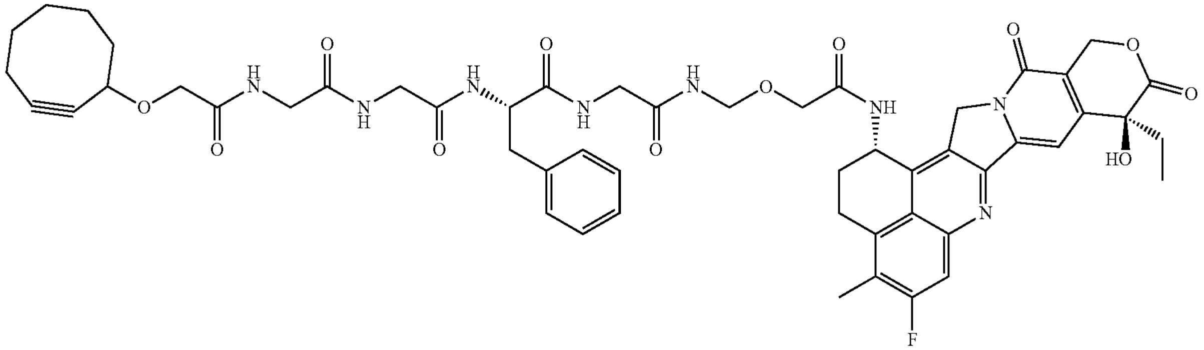
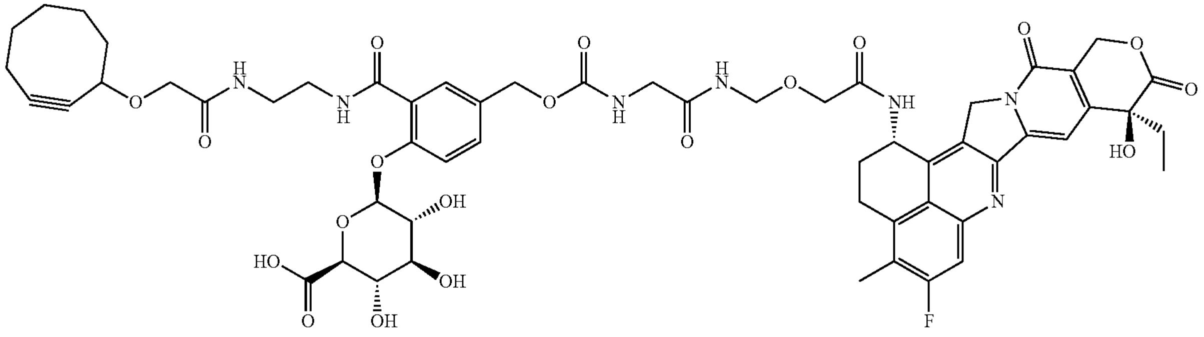
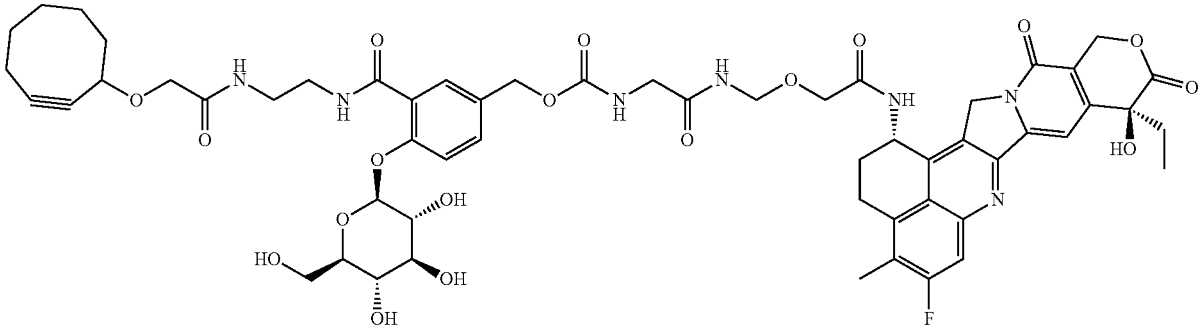
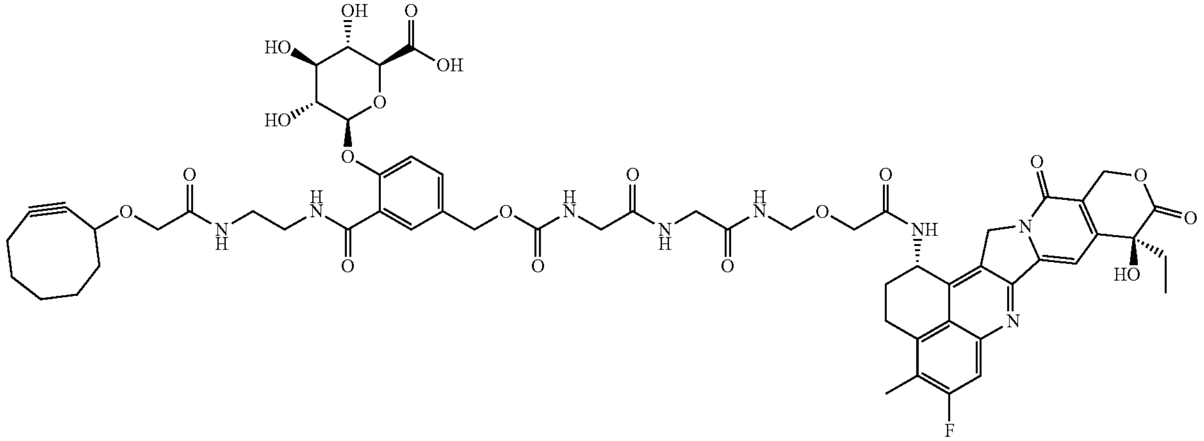
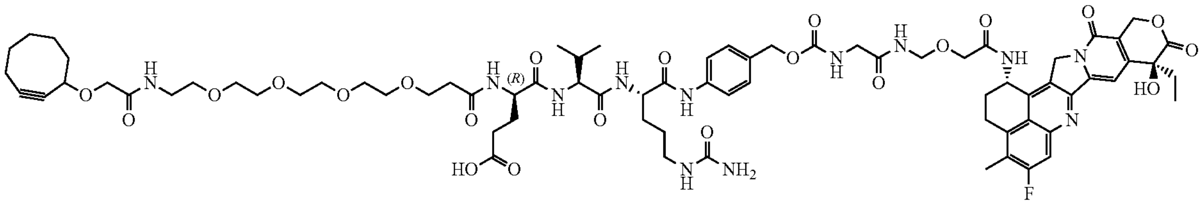

-continued
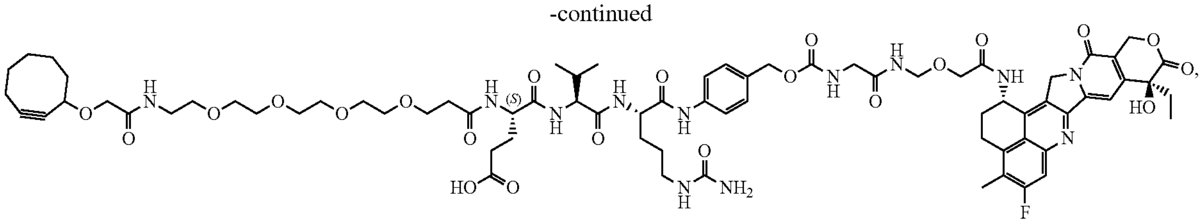
or a pharmaceutically acceptable salt thereof.
In one embodiment, the compound has a structure selected from the group
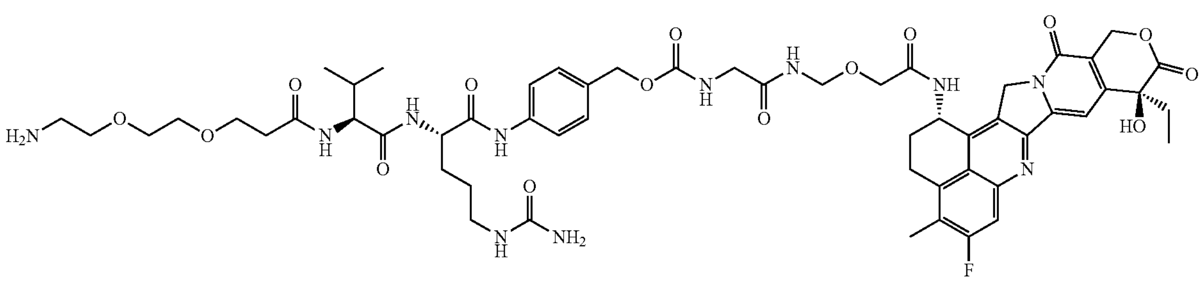
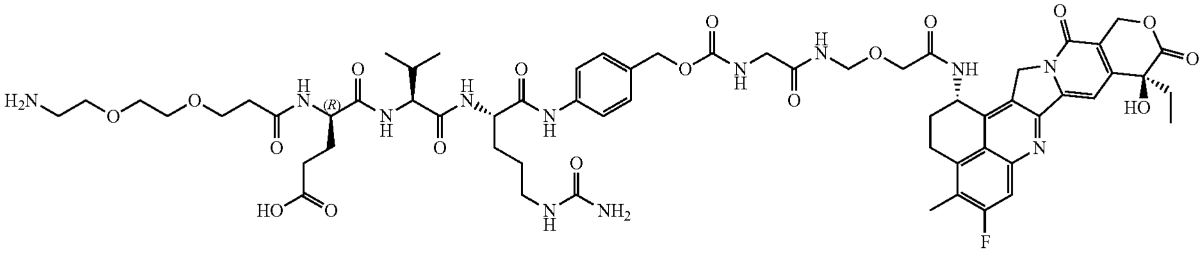
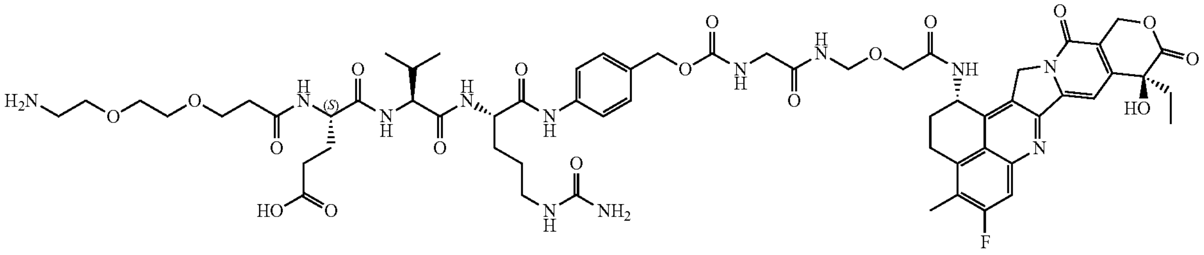
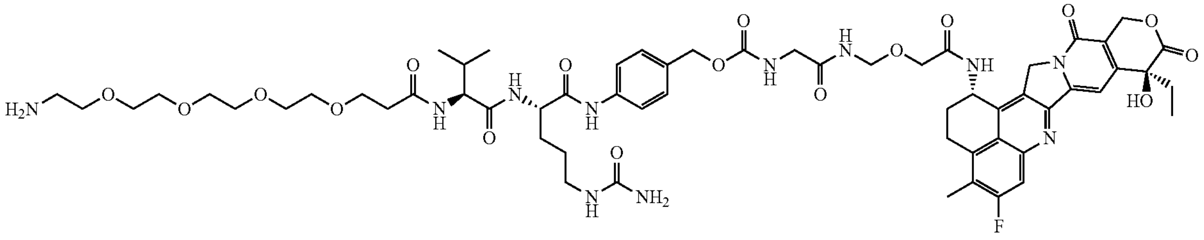
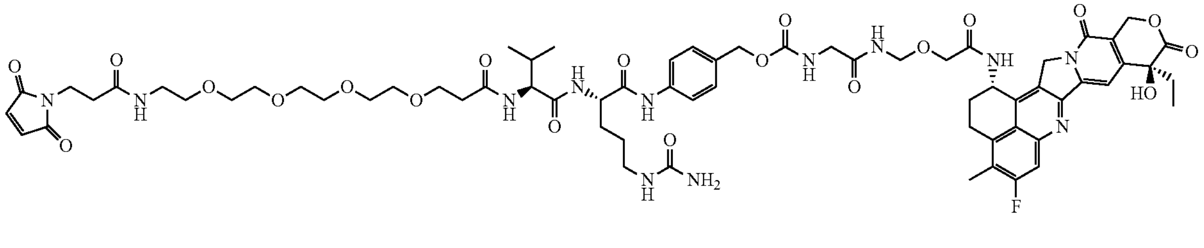

-continued
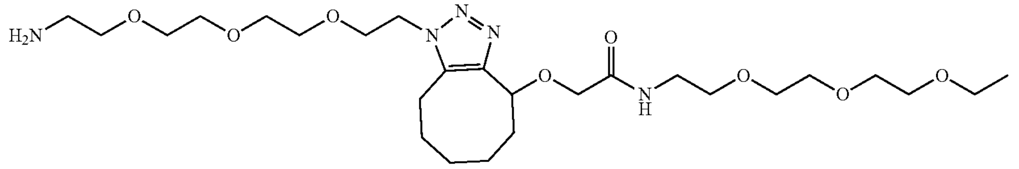
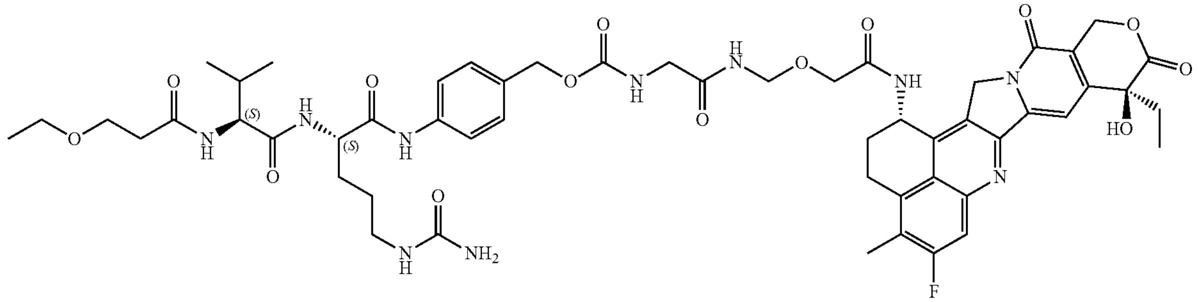
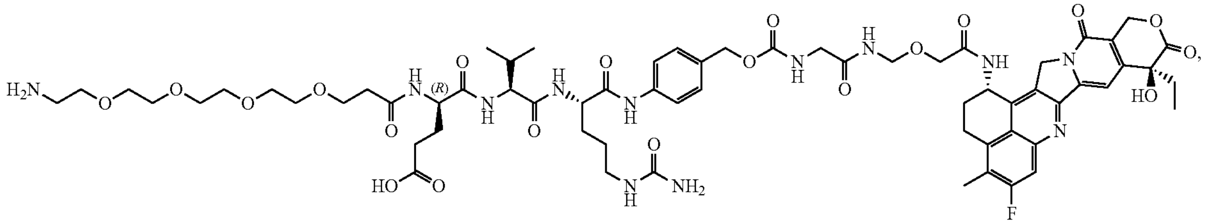
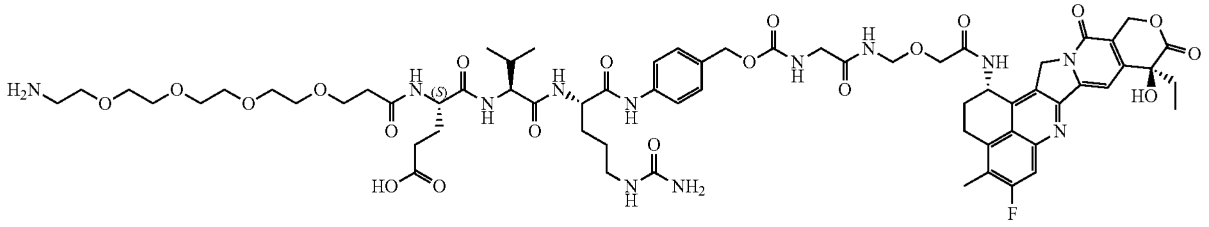
or a pharmaceutically acceptable salt thereof.
In one embodiment, the compound has a structure according to Formula (L2-P), (L2'-P) or (L2"-P) selected from the group consisting of:
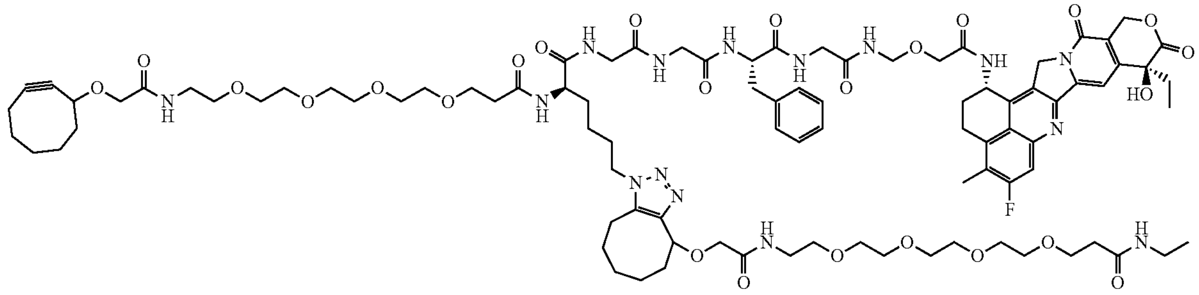
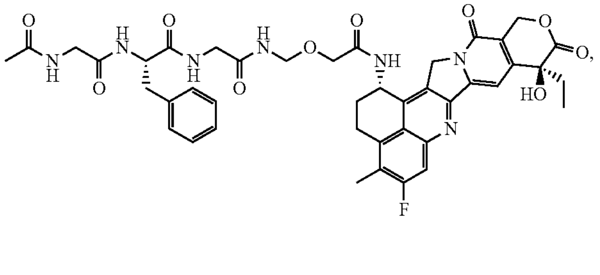

-continued
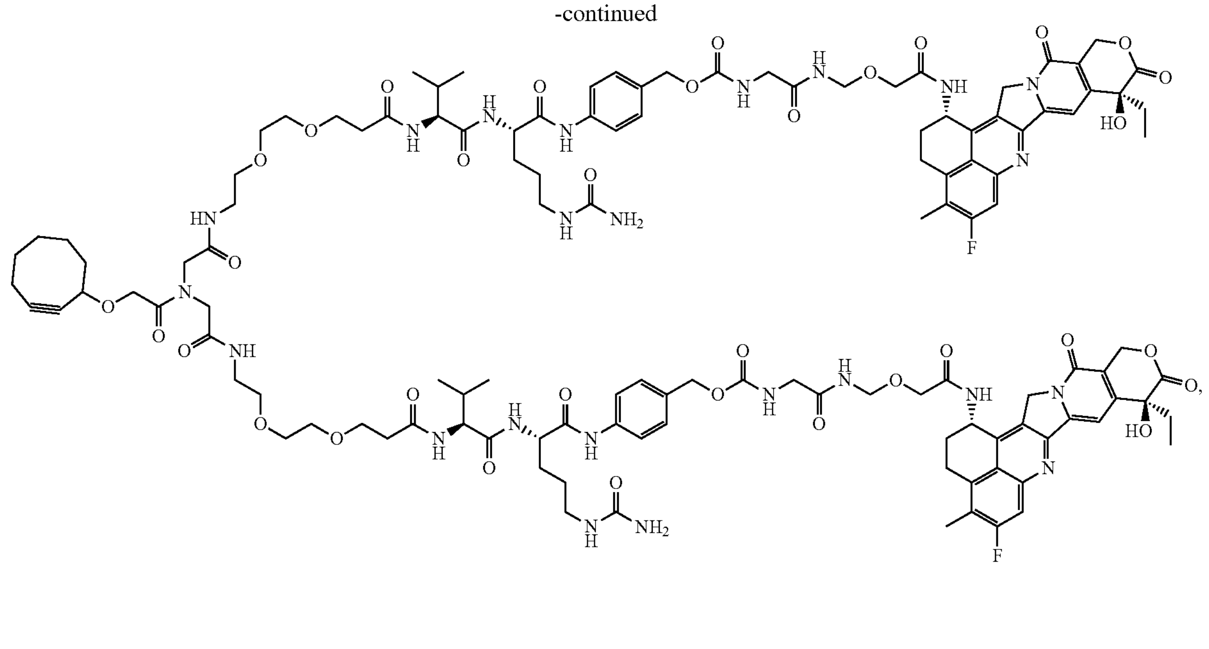
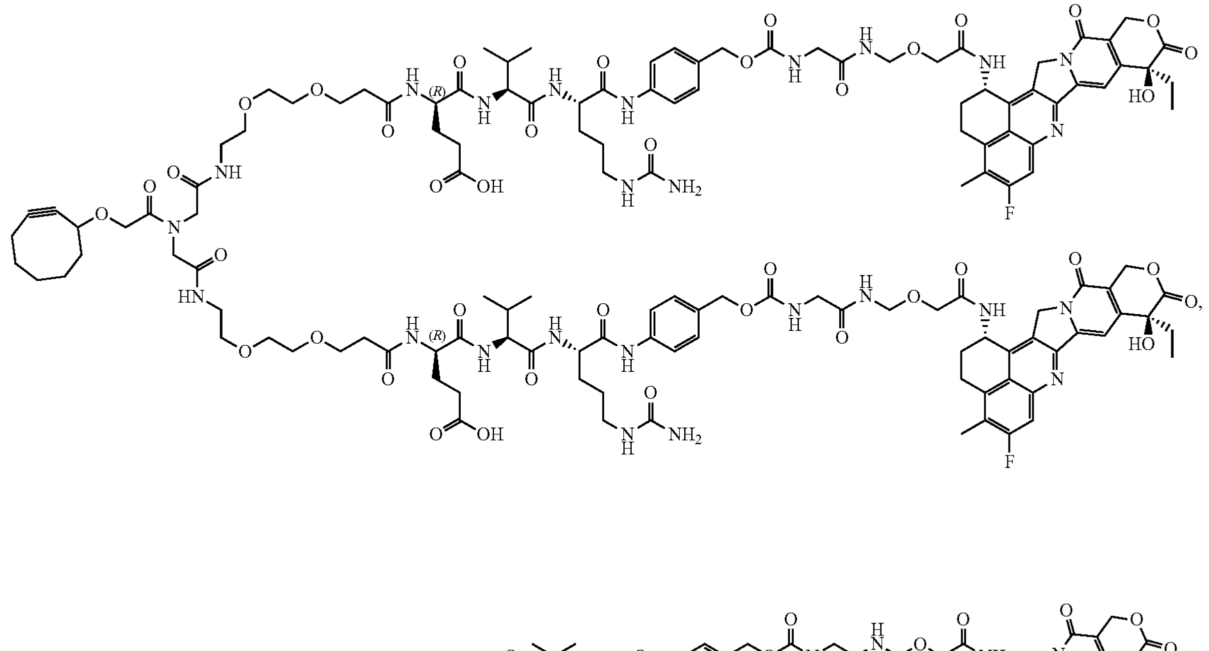
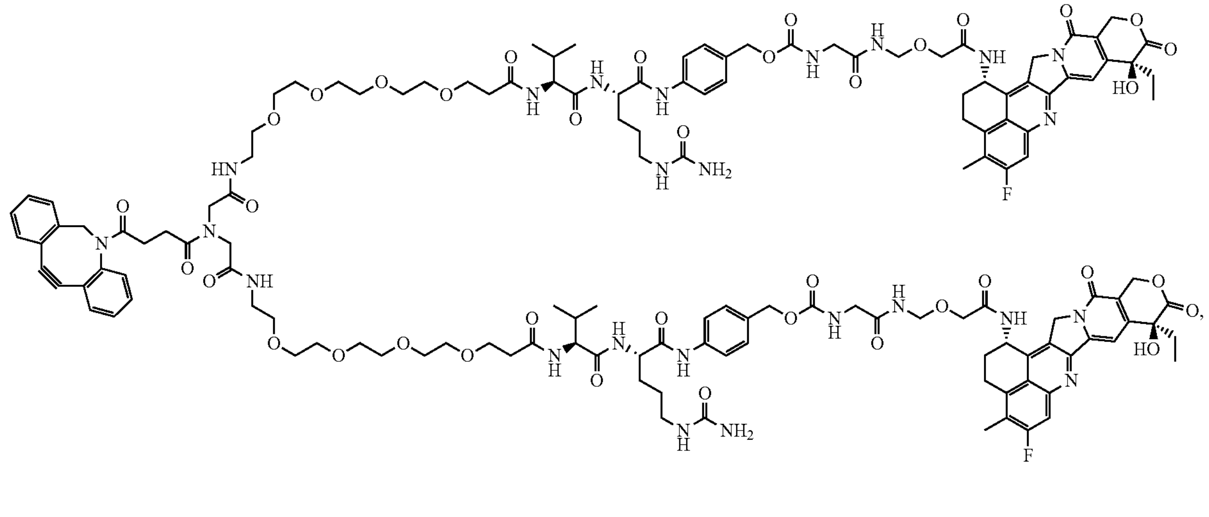

-continued
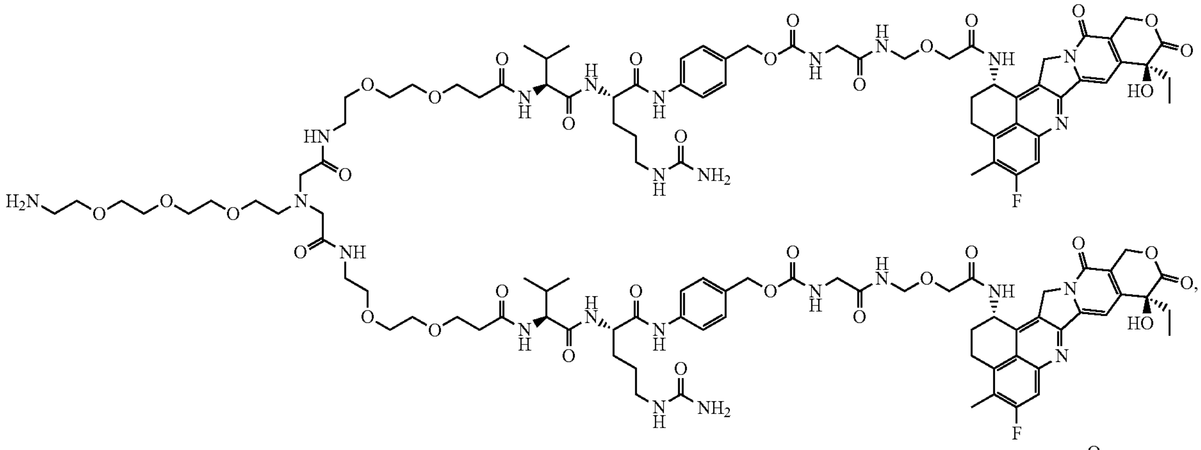
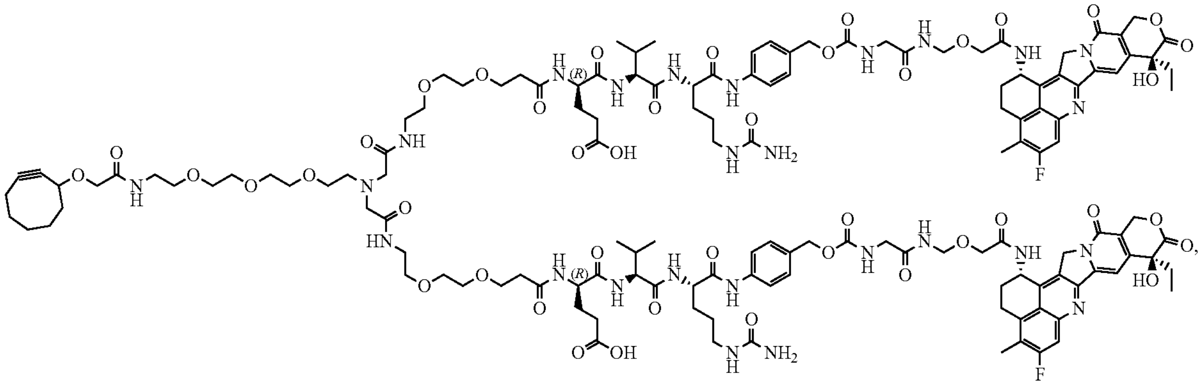
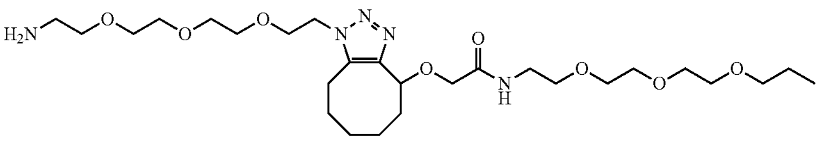
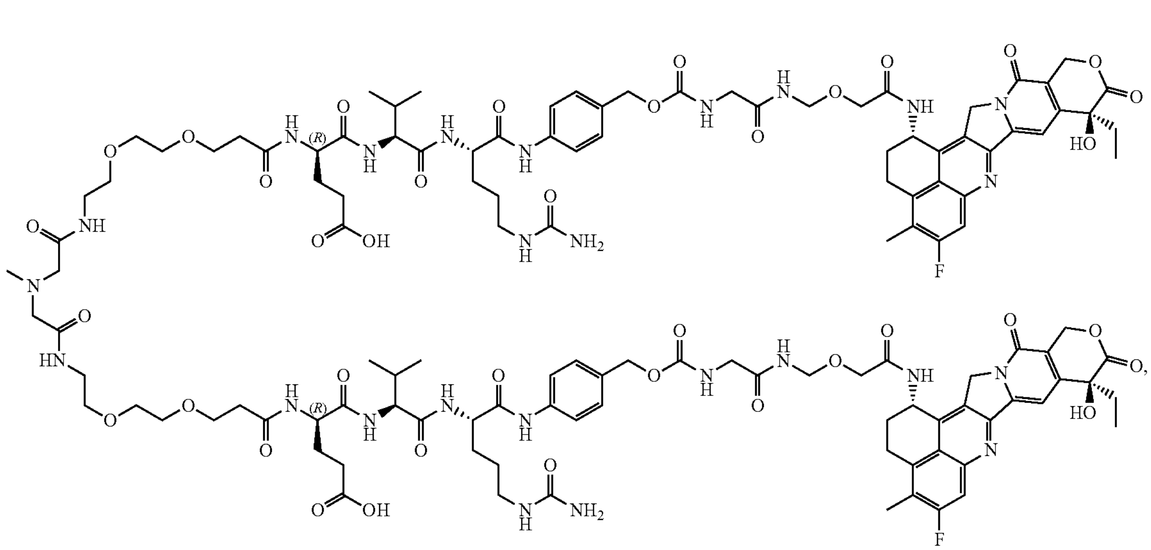

-continued
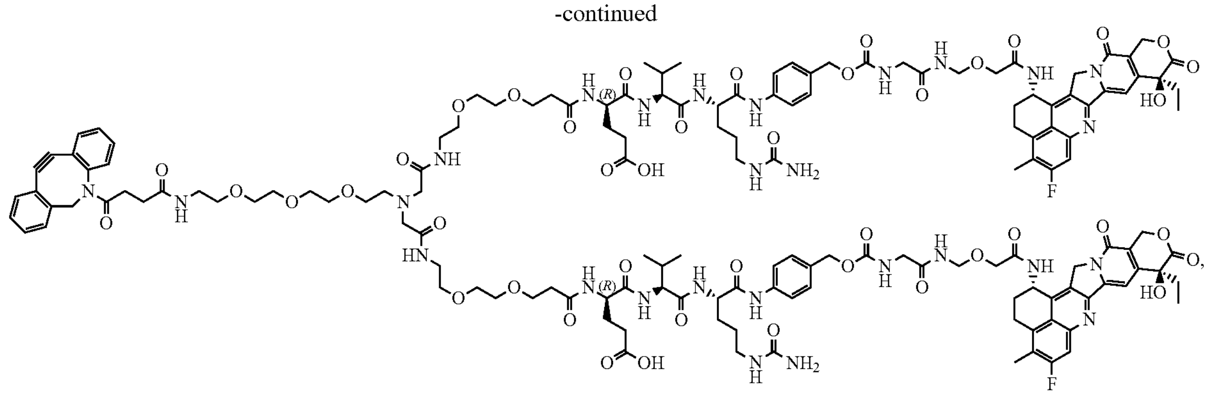
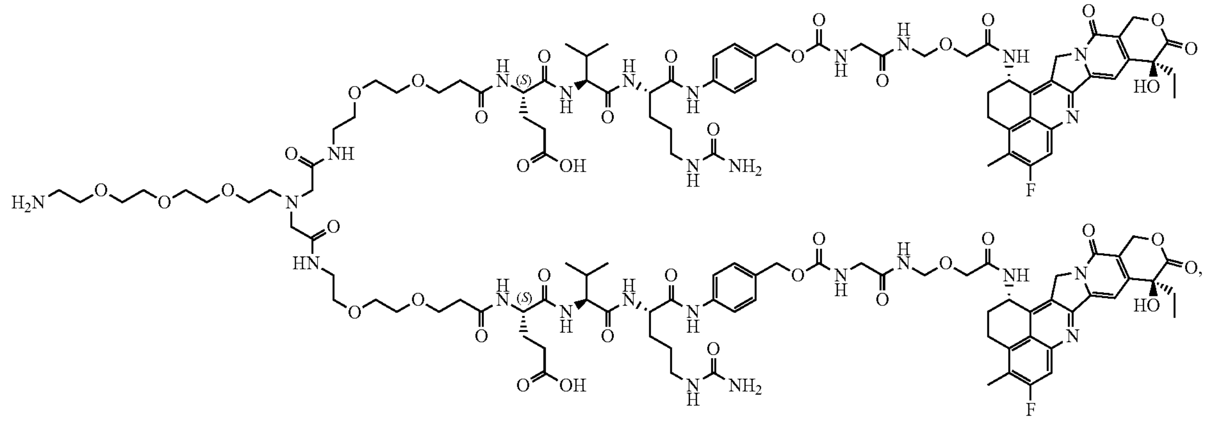
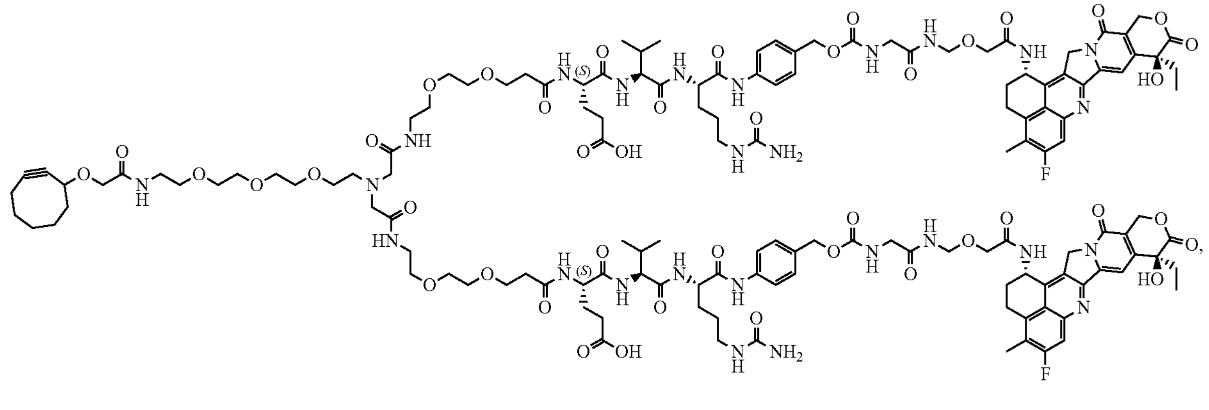
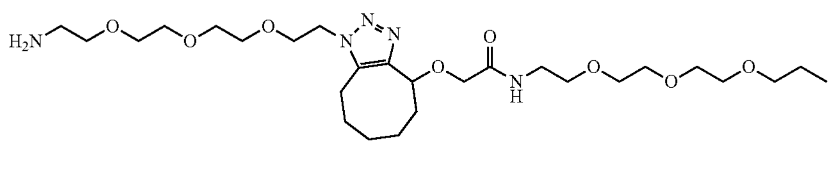

-continued
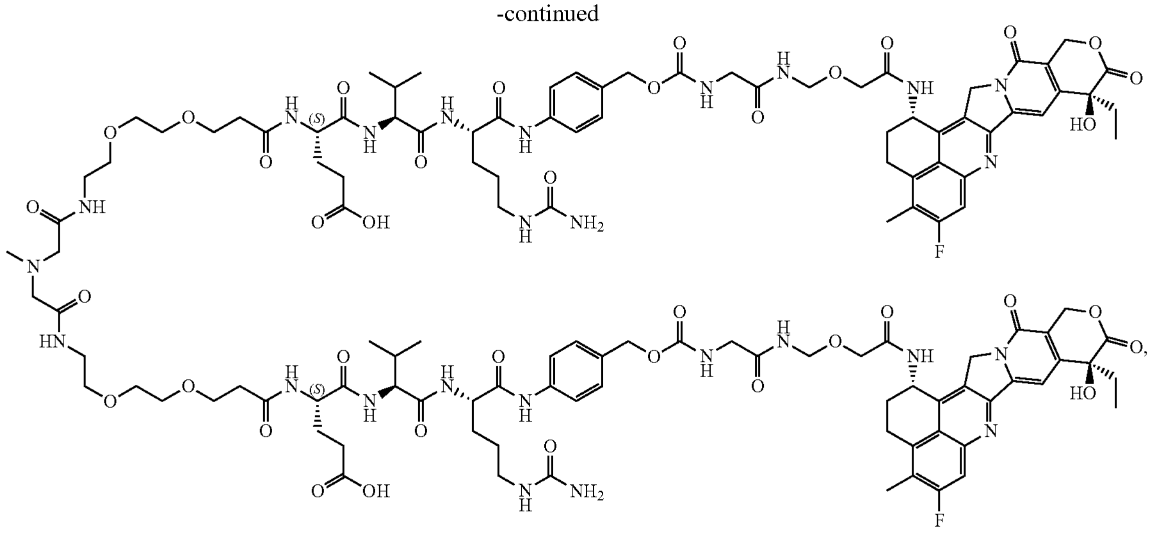
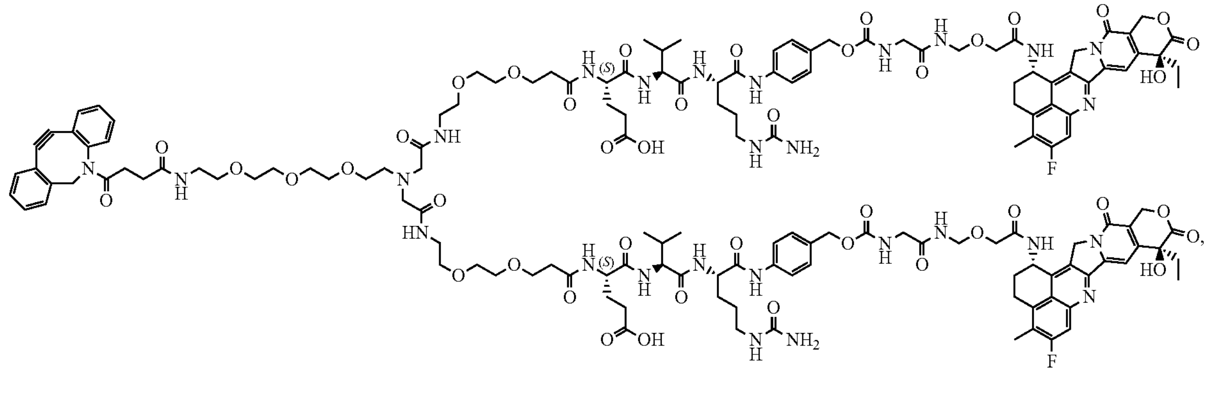
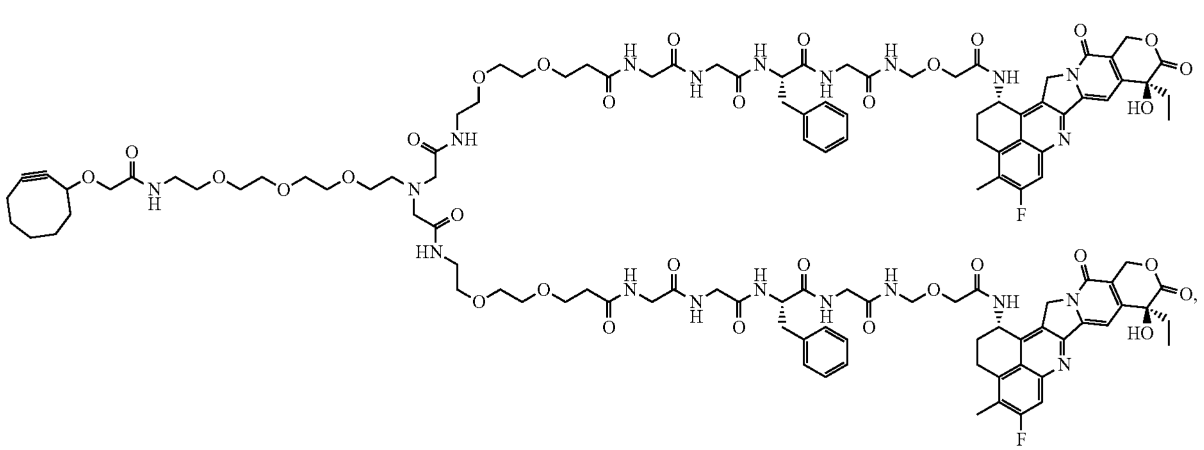

-continued
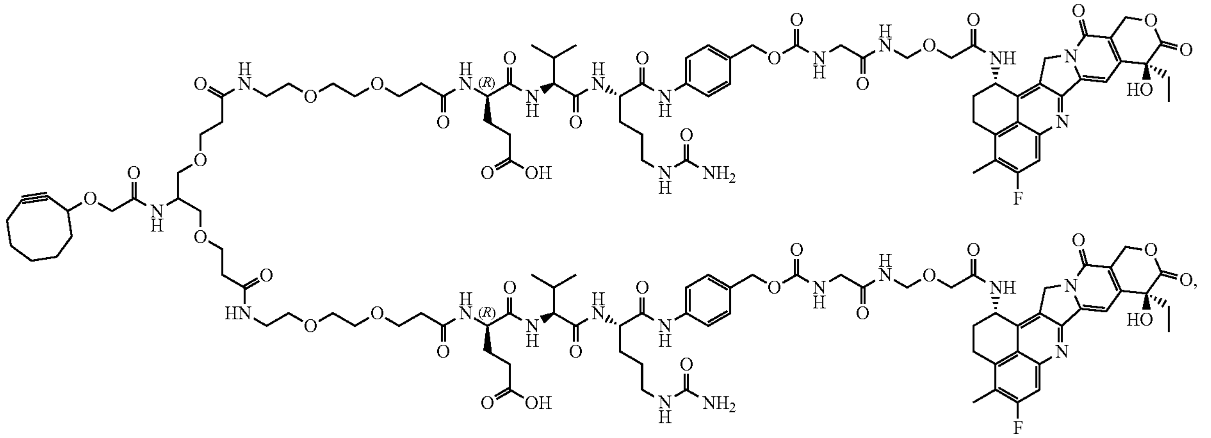
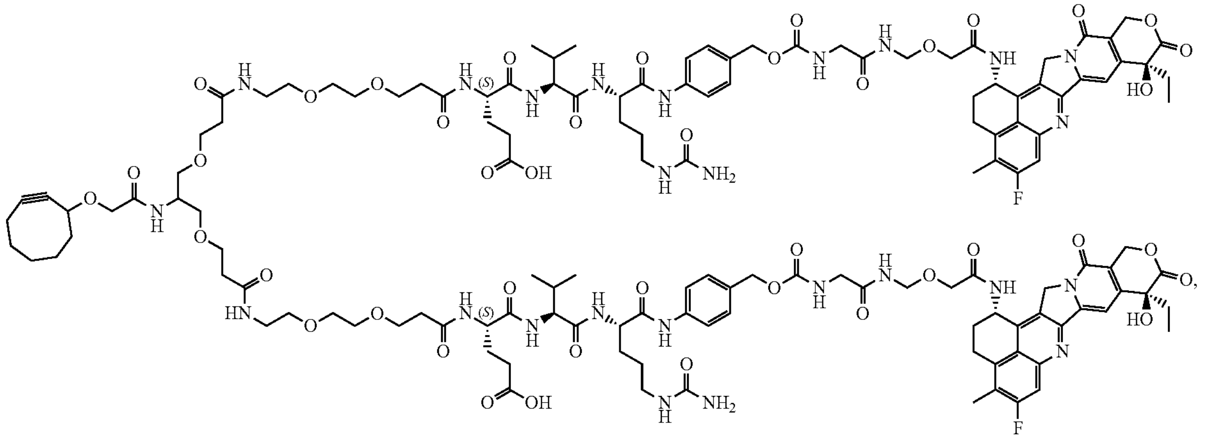
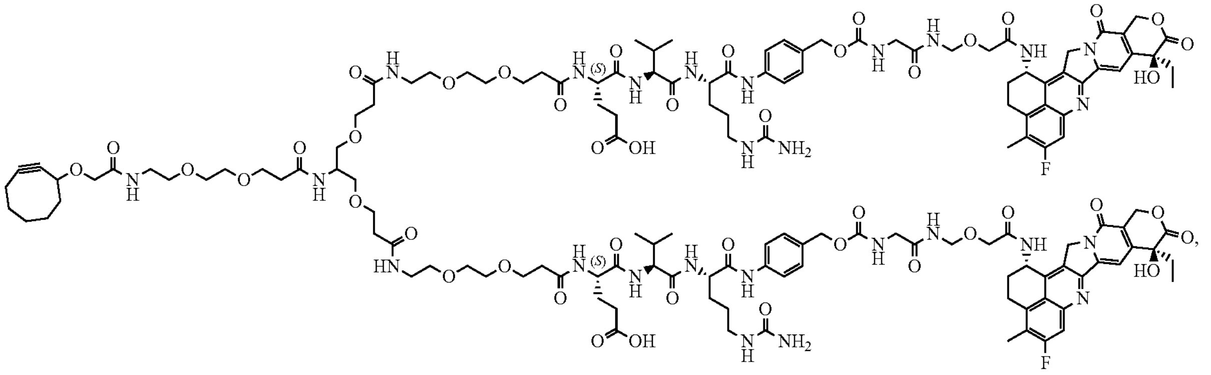
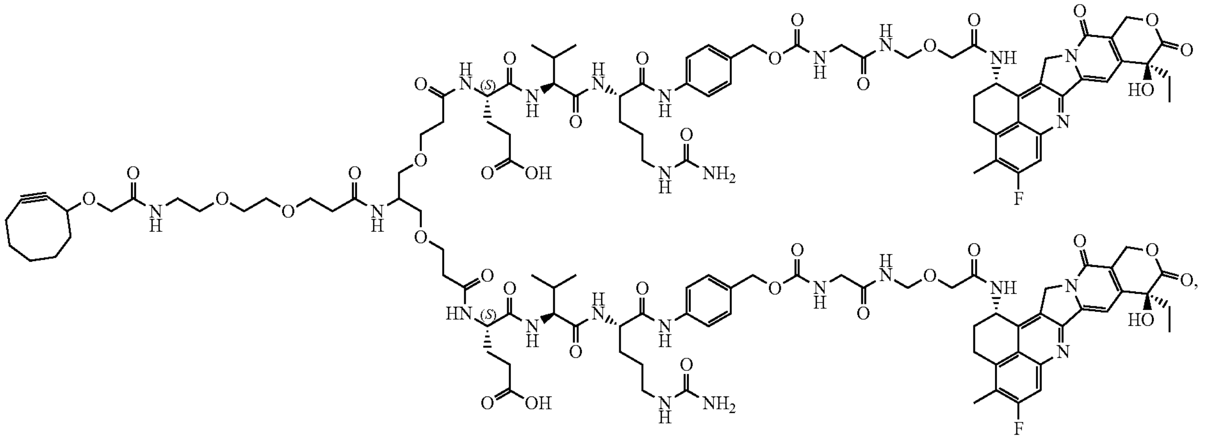

-continued
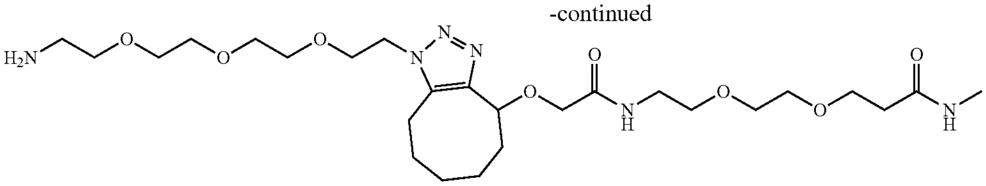
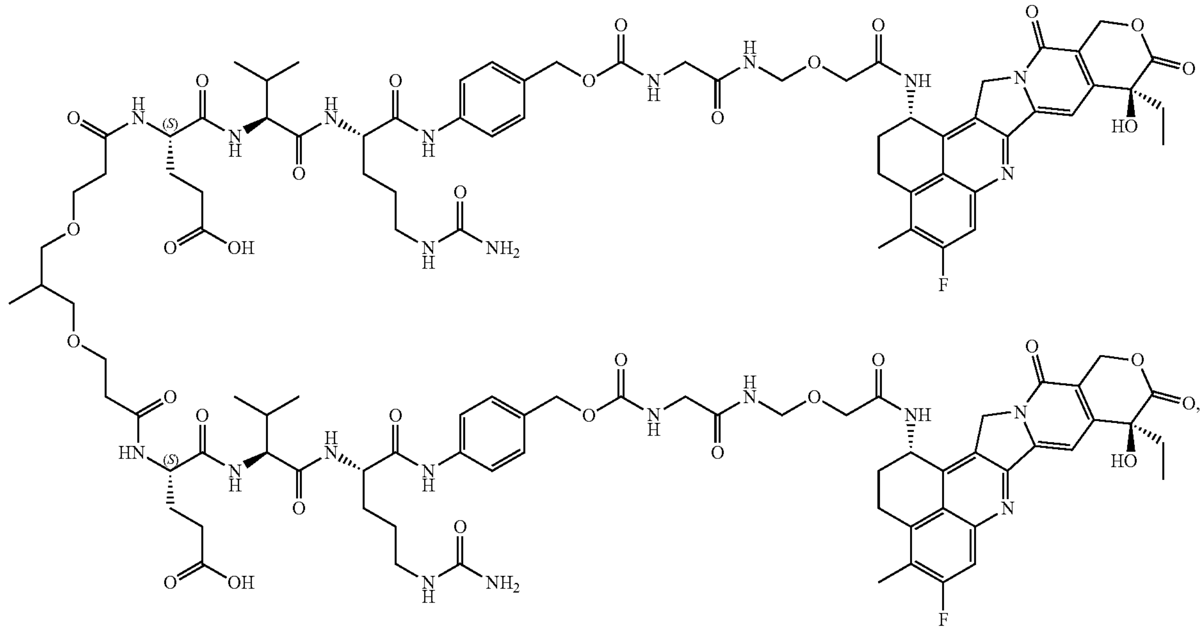
,
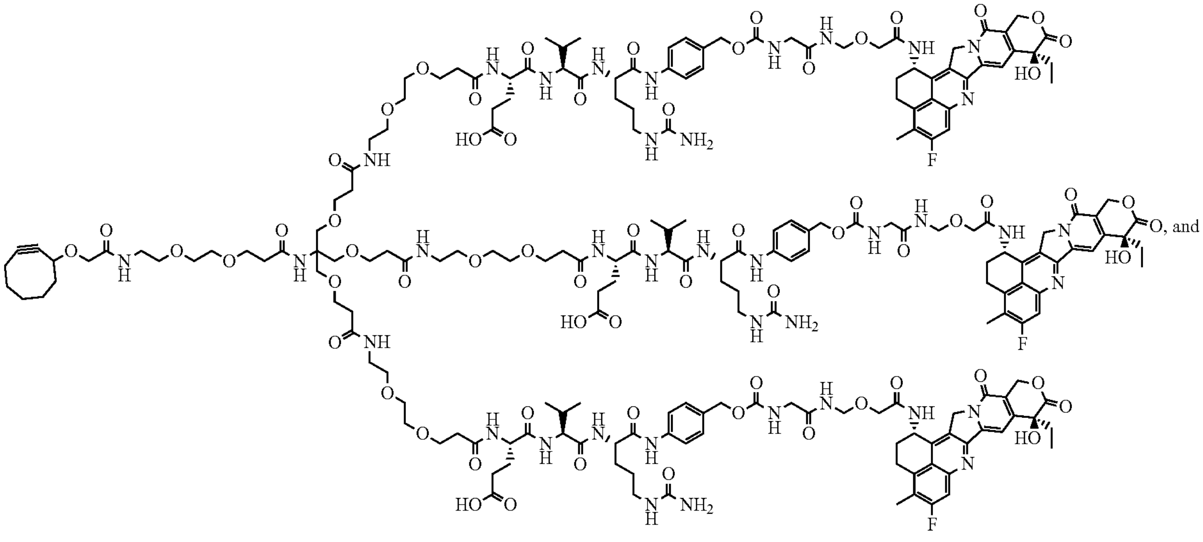
, and
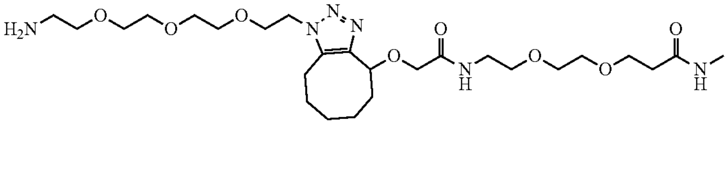

-continued

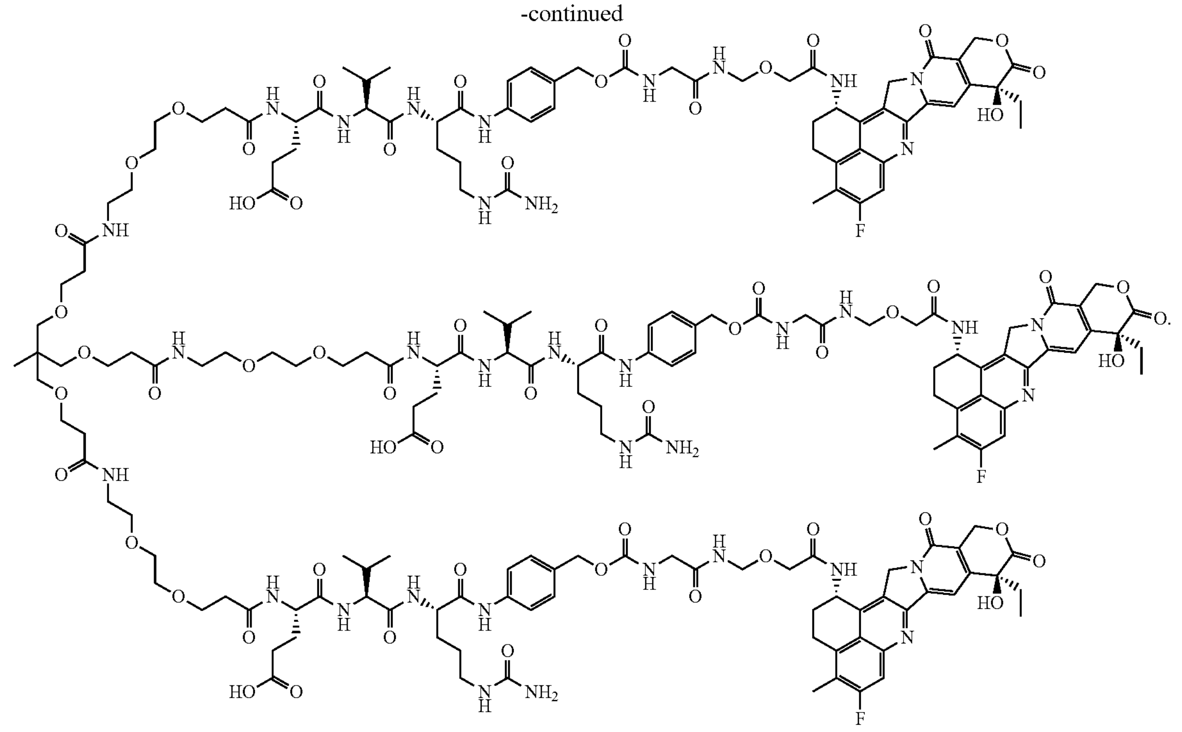

In another aspect, the present disclosure provides an antibody-drug conjugate according to formula (II):

$$Ab\text{-}(Gln\text{-}NH\text{-}L1\text{-}B\text{-}(SP1\text{-}B2\text{-}(\text{-}SP2\text{-}AA\text{-}SP3\text{-}M\text{-}Dxd)_k)_p)_n \quad (II),$$

wherein Ab is an antibody;

Gln is a glutamine residue;

L1 is absent or a first linker;

B is a branching unit comprising at least one adduct of group B' and group B'', where the group B' is selected from

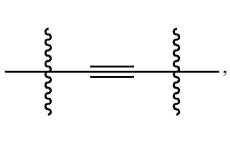,

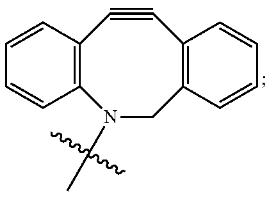;

-continued

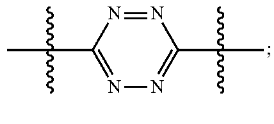;

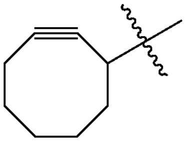

and at least one group B'', wherein

B''-SP1-B2-(-SP2-AA-SP3-M-Dxd)p is the compound according to formula (L2-P) according to any of the preceding embodiments, and wherein the compound of formula (L2-P) is covalently attached to the antibody via the adduct of the group B' and the group B''; k is an integer from 1 to 12, p is an integer from 1 to 30, and n is an integer from 1 to 30.

In one embodiment, the present disclosure provides an antibody-drug conjugate comprising an antibody and a linker-payload, wherein the linker-payload comprises the structure:

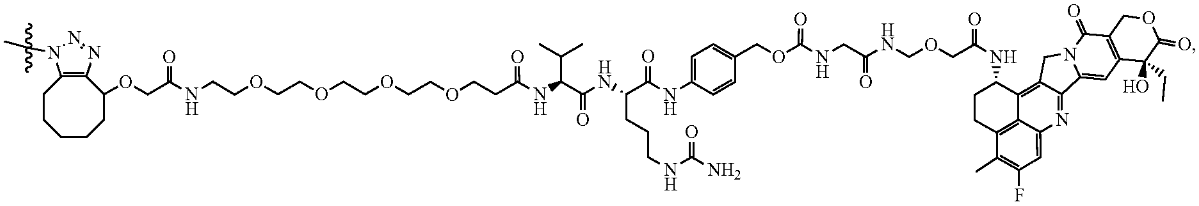, or

-continued

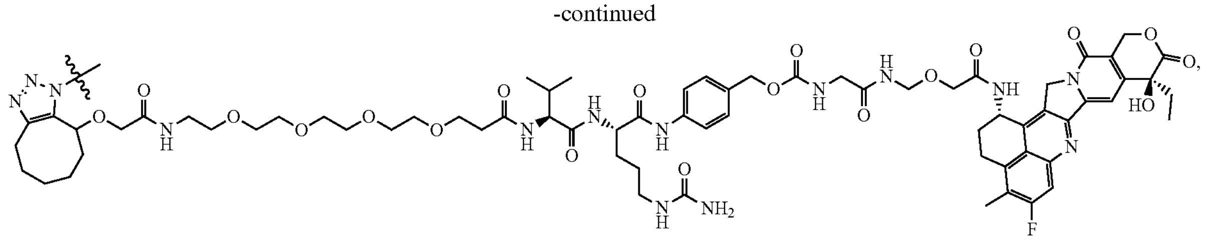

where ∿∿∿ represents the point of attachment to the antibody, directly or through a second linker, or a pharmaceutically acceptable salt thereof.

In another aspect, the present disclosure provides a composition comprising a population of compounds according to any of the preceding embodiments, having a drug-antibody ratio (DAR) of about 0.5 to about 30.0.

In one embodiment, the composition according to the disclosure has a DAR of about 1.0 to about 2.5. In one embodiment, the composition according to the disclosure has a DAR of about 2.

In one embodiment, the composition according to the disclosure has a DAR of about 3.0 to about 4.5. In one embodiment, the composition according to the disclosure has a DAR of about 4.

In one embodiment, the composition according to the disclosure has a DAR of about 6.5 to about 8.5. In one embodiment, the composition according to the disclosure has a DAR of about 8.

In one embodiment, the composition according to the disclosure has a DAR of about 10 to about 14. In one embodiment, the composition according to the disclosure has a DAR of about 12.

In one embodiment, the composition according to the disclosure has a DAR of about 14 to about 18. In one embodiment, the composition according to the disclosure has a DAR of about 16.

In one embodiment, the composition according to the disclosure has a DAR of about 22 to about 24.5. In one embodiment, the composition according to the disclosure has a DAR of about 24.

In another aspect, the present disclosure provides a compound having a structure according to Formula (P-I):

(P-I)

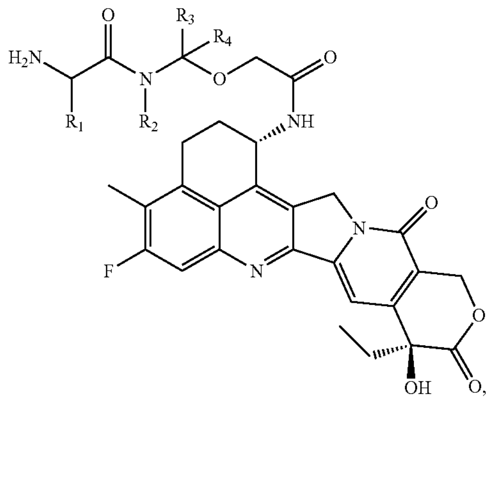

wherein $R_1$, $R_2$, $R_3$, and $R_4$ are independently a hydrogen or a $C_1$-$C_4$ alkyl, or wherein $R_2$ and $R_3$ form a 5-membered or a 6-membered ring, or a pharmaceutically acceptable salt thereof.

In one embodiment, the compound is

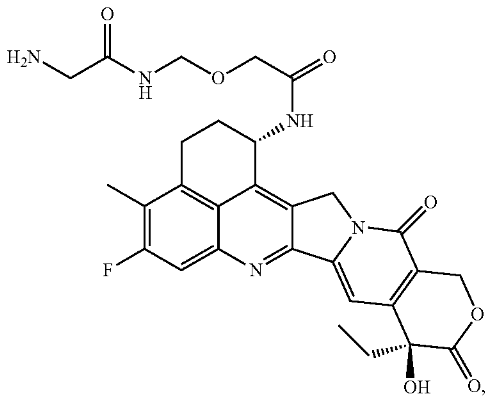 [SMILES: CC[C@@]1(O)C(=O)OCc2c1cc1n(c2=O)Cc2c-1nc1cc(F)c(C)c3c1c2[C@@H](NC(=O)COCNC(=O)CN)CC3]

or a pharmaceutically acceptable salt thereof.

An antibody-drug conjugate comprising an antibody, a linker, and a payload, wherein the payload is

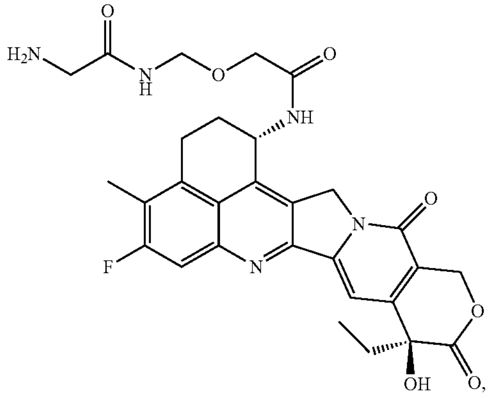 [SMILES: CC[C@@]1(O)C(=O)OCc2c1cc1n(c2=O)Cc2c-1nc1cc(F)c(C)c3c1c2[C@@H](NC(=O)COCNC(=O)CN)CC3]

or a pharmaceutically acceptable salt thereof.

An antibody-drug conjugate comprising an antibody, a linker, and a payload, wherein the payload is

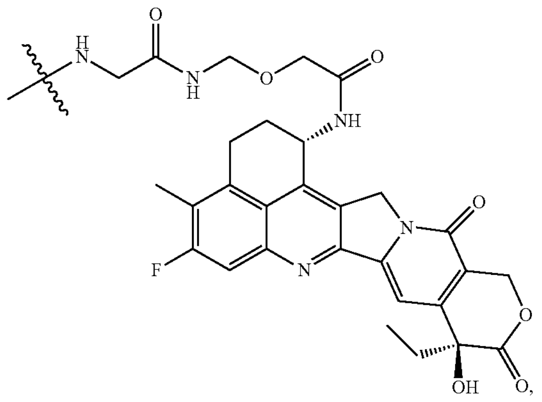 [SMILES: *NCC(=O)NCOCC(=O)N[C@H]1CCc2c(C)c(F)cc3nc4c(c1c23)Cn1c-4cc2c(c1=O)COC(=O)[C@]2(O)CC]

or a pharmaceutically acceptable salt thereof, where ∿∿ represents the point of attachment to the linker.

In one embodiment, the compound has a structure according to Formula (P2):

(P2)

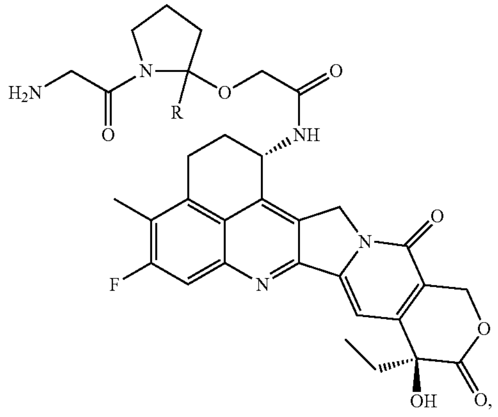

wherein R is a hydrogen or a $C_1$-$C_4$ alkyl, or a pharmaceutically acceptable salt thereof.

In one embodiment, the compound is

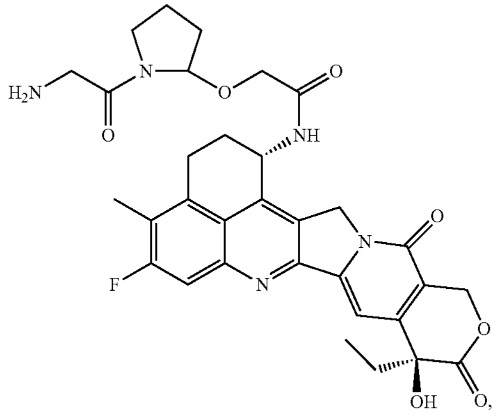 [SMILES: CC[C@@]1(O)C(=O)OCc2c1cc1n(c2=O)Cc2c-1nc1cc(F)c(C)c3c1c2[C@@H](NC(=O)COC1CCCN1C(=O)CN)CC3]

or a pharmaceutically acceptable salt thereof.

In one aspect, the present invention provides a pharmaceutical composition comprising the compound according to any of the preceding embodiments, and a diluent, a carrier, and/or an excipient.

In one aspect, the present invention provides a method of treating a condition in a subject in need thereof comprising administering to the subject a therapeutically effective amount of the compound according to any of the preceding embodiments, or the composition of any one of the preceding embodiments.

In one embodiment, the condition is cancer.

In one embodiment, the cancer is selected from the group consisting of breast cancer, ovarian cancer, prostate cancer, lung cancer, liver cancer, or brain cancer.

In one embodiment, the condition is HER2+ breast cancer.

In one aspect, the present invention provides a method of selectively delivering a compound into a cell, wherein the compound is according to any one of the preceding embodiments.

In one aspect, the present invention provides a method of selectively targeting an antigen on a surface of a cell with a compound, wherein the compound is according to any one of the preceding embodiments.

In one embodiment, the cell is a mammalian cell.

In one embodiment, the cell is a human cell.

In one embodiment, the cell is a cancer cell.

In one embodiment, the cancer cell is selected from the group consisting of a breast cancer cell, an ovarian cancer cell, a prostate cancer cell, a lung cancer cell, a liver cancer cell, or a brain cancer cell.

In one aspect, the present disclosure provides a method of producing a compound having a structure according to Formula (A):

$$\text{BA-(Gln-NH-L1-B-(-L2-(-M-Dxd)}_m)_k)_n \quad \text{(A),}$$

wherein BA is an antibody or an antigen-binding fragment thereof;

Gln is a glutamine residue;

L1 is a first linker;

B is a branching unit comprising at least one adduct of a group B' and a group B";

L2 is a second linker covalently attached to the branching unit B via at least one group B";

M is absent or

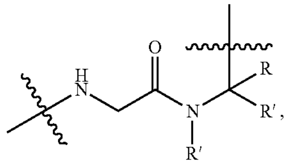

where R, R', and R" are independently at each occurrence hydrogen or a $C_1$-$C_4$ alkyl, or wherein R' and R" together form a 5-membered or a 6-membered ring;

Dxd is an anti-tumor agent comprising a structure according to Formula (P):

(P)

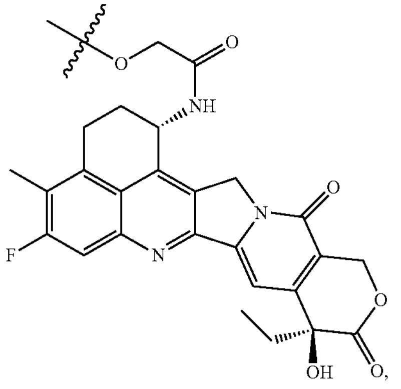

k and m are independently an integer from 1 to 12, and n is an integer from 1 to 30, wherein:

the method comprises the steps of:

a) contacting, in the presence of a transglutaminase, the BA comprising at least one glutamine residue Gln ($BA\text{-}Gln\text{-}NH_2$) with a compound L1-B, wherein the branching unit B comprises the at least one group B', b) contacting the product of step a) with k or more equivalents of a compound $L2\text{-}(\text{-}M\text{-}Dxd)_m$, wherein the linker L2 comprises at least one group B", wherein one of the groups B' and B" is selected from $-N_3$ and

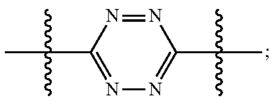 [SMILES: *c1nnc(*)nn1]

;

and the other of the groups B' and B" is selected from

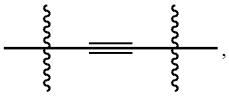

,

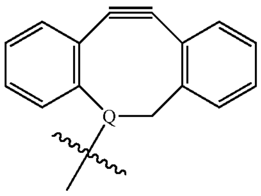

; and

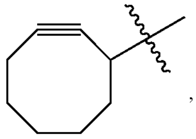

, where Q is C or N; and c) isolating the produced compound of Formula (I).

In one aspect, the present disclosure provides a method of producing a compound having a structure according to Formula (A):

$$BA\text{-}(Gln\text{-}NH\text{-}L1\text{-}B\text{-}(\text{-}L2\text{-}(\text{-}M\text{-}Dxd)_m)_k)_n \quad (A),$$

wherein BA is an antibody or an antigen-binding fragment thereof; Gln is a glutamine residue; L1 is a first linker as described above; B is a branching unit comprising at least one adduct of a group B' and a group B" as described above; L2 is a second linker as described above covalently attached to the branching unit B via at least one group B" as described above; M is absent or

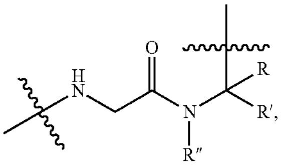

where R, R', and R" are as described above; Dxd is an anti-tumor agent comprising a structure according to Formula (P):

(P)

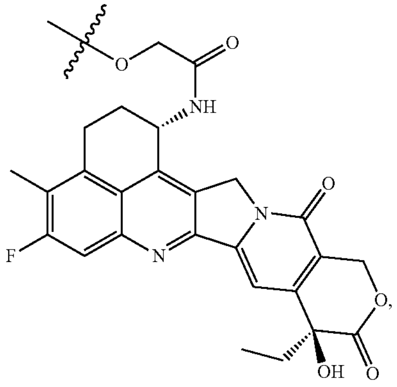

k and m are independently an integer from 1 to 12, and n is an integer from 1 to 30, wherein:

the method comprises the steps of:

a) contacting a compound L1-B, wherein the branching unit B comprises the at least one group B', with k or more equivalents of a compound $L2\text{-}(\text{-}M\text{-}Dxd)_m$, wherein the linker L2 comprises at least one group B" capable of covalently binding with the group B', wherein one of the groups B' and B" is selected from $-N_3$ and

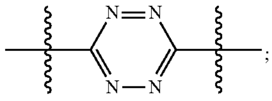 [SMILES: *c1nnc(*)nn1]

;

and the other of the groups B' and B" is selected from

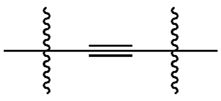

,

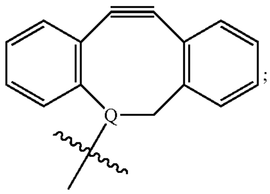

; and

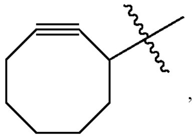

, where Q is C or N;

thereby producing $L1\text{-}B\text{-}(\text{-}L2\text{-}(\text{-}M\text{-}Dxd)_m)_k$;

b) contacting, in the presence of a transglutaminase, the BA comprising at least one glutamine residue Gln ($BA-Gln-NH_2$) with the $L1-B-(-L2-(-M-Dxd)_m)_k$ product of step a), and c) isolating the produced compound of Formula (I).

In one aspect, the present disclosure provides a method of producing a compound having a structure according to Formula (I):

$$BA-(Gln-NH-L1-B-(-L2-M-Dxd)_k)_n \quad (I),$$

wherein BA is an antibody or an antigen-binding fragment thereof;

Gln is a glutamine residue;

L1 is a first linker;

B is a branching unit comprising at least one adduct of a group B' and a group B";

L2 is a second linker covalently attached to the branching unit B via at least one group B";

M is absent or

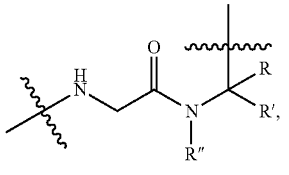

where R, R', and R" are independently at each occurrence hydrogen or a $C_1$-$C_4$ alkyl, or wherein R' and R" together form a 5-membered or a 6-membered ring;

Dxd is an anti-tumor agent comprising a structure according to Formula (P):

(P)

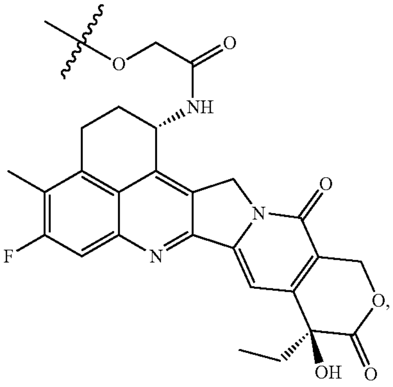

k is an integer from 1 to 12, and n is an integer from 1 to 30, wherein:

the method comprises the steps of:

a) contacting, in the presence of a transglutaminase, the BA comprising at least one glutamine residue Gln ($BA-Gln-NH_2$) with a compound L1-B, wherein the branching unit B comprises the at least one group B', b) contacting the product of step a) with k or more equivalents of a compound L2-M-Dxd, wherein the linker L2 comprises the at least one group B" capable of covalently attaching to the group B', wherein one of the groups B' and B" is selected from $-N_3$ and

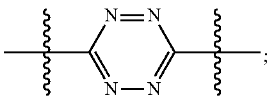 [SMILES: *c1nnc(*)nn1];

and the other of the groups B' and B" is selected from

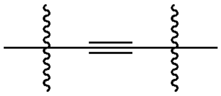,

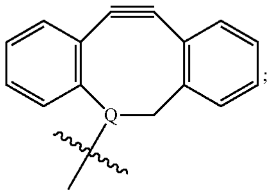; and 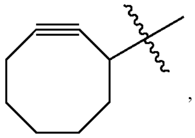, where Q is C or N; and c) isolating the produced compound of Formula (I).

In one aspect, the present disclosure provides a method of producing a compound having a structure according to Formula (I):

$$BA-(Gln-NH-L1-B-(-L2-M-Dxd)_k)_n \quad (I),$$

wherein BA is an antibody or an antigen-binding fragment thereof; Gln is a glutamine residue; L1 is a first linker as described above; B is a branching unit comprising at least one adduct of a group B' and a group B" as described above; L2 is a second linker as described above covalently attached to the branching unit B via at least one group B" as described above; M is absent or

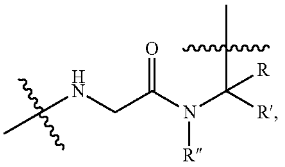

where R, R', and R" are as described above; Dxd is an anti-tumor agent comprising a structure according to Formula (P):

(P)

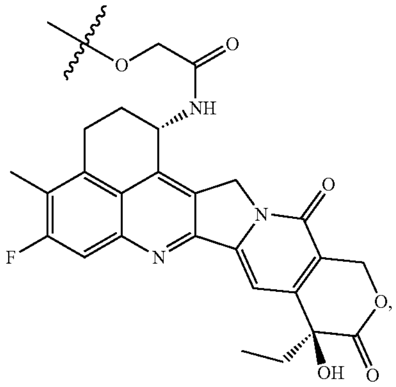

k is an integer from 1 to 12, and n is an integer from 1 to 30, wherein:

the method comprises the steps of:

a) contacting a compound L1-B, wherein the branching unit B comprises the at least one group B' with k or more equivalents of a compound L2-M-Dxd, wherein the linker L2 comprises at least one group B", thereby producing L1-B-(-L2-M-Dxd)$_k$, wherein one of the groups B' and B" is selected from —$N_3$ and

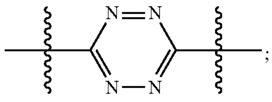 [SMILES: *c1nnc(*)nn1];

and the other of the groups B' and B" is selected from

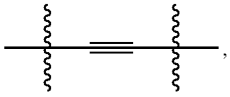,

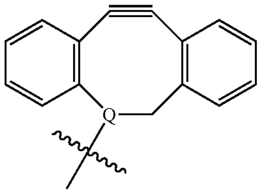; and 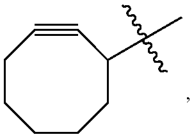, where Q is C or N;

b) contacting, in the presence of a transglutaminase, the binding agent BA comprising at least one glutamine residue Gln (BA-Gln-$NH_2$) with the L1-B-(-L2-M-Dxd)$_k$ product of step a), and c) isolating the produced compound of Formula (I).

In one aspect, the present disclosure provides a method of producing a compound having a structure according to Formula (III):

BA-(Gln-NH-L2'-P))$_n$ (III), wherein BA is an antibody or an antigen-binding fragment thereof; Gln is a glutamine residue; L2'-P is $H_2N$-SP1-B2-(-SP2-AA-SP3-M-Dxd)p as described above, and n is an integer from 1 to 30;

SP1 is absent or a first spacer unit selected from the group consisting of

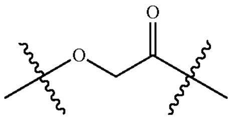 and

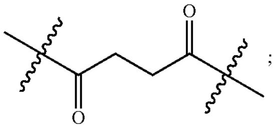;

B2 is absent or a branching unit;

SP2 is absent or a second spacer unit selected from the group consisting of a $C_{1-6}$ alkyl, —$(CH_2—CH_2—O)_v$—, —NH—, —C(O)—, —NH—C(O)—, —NH—$(CH_2)_u$—, —NH—$(CH_2)_u$—C(O)—, —NH—$(CH_2—CH_2—O)_v$—, —NH—$(CH_2—CH_2—O)_v$—C(O)—, —NH—$(CH_2—CH_2—O)_v$—$(CH_2)_u$—, —NH—$(CH_2—CH_2—O)_v$—$(CH_2)_u$—C(O)—, —$(CH_2)_u$—NH—C(O)—, —NH—$(CH_2)_u$—NH—C(O)—, —NH—$(CH_2)_u$—C(O)—NH—, or combinations thereof; wherein subscripts u and v are independently an integer from 1 to 8;

AA is absent or a peptide unit comprising from 2 to 4 amino acids;

SP3 is absent or a third spacer unit selected from the group consisting of,

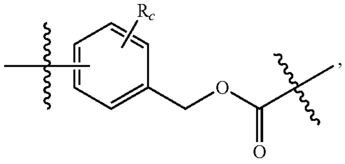,

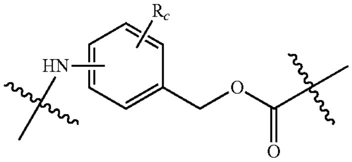,

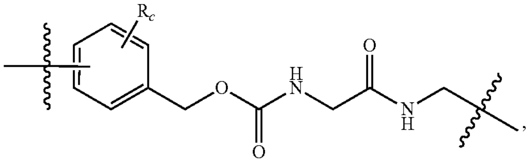,

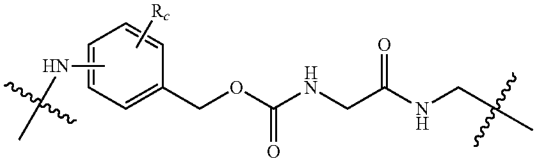, wherein $R_c$ is independently at each occurrence absent or a group selected from

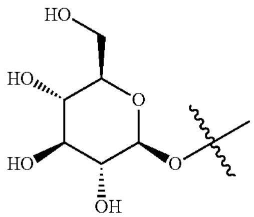 and

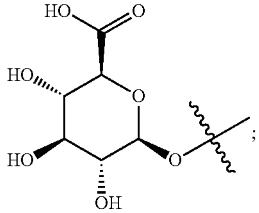;

M is absent or

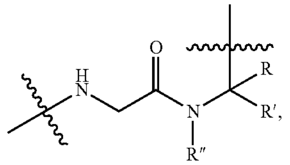

where R, R', and R" are independently at each occurrence hydrogen or a $C_1$-$C_4$ alkyl, or wherein R' and R" together form a 5-membered or a 6-membered ring; and Dxd is an anti-tumor agent having a structure according to Formula (P):

(P)

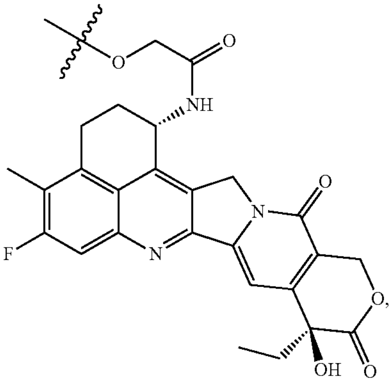

p is an integer from 1 to 30;

wherein the method comprises the steps of:

b) contacting, in the presence of a transglutaminase, the BA comprising at least one glutamine residue Gln (BA-Gln-$NH_2$) with the L2'-P, and c) isolating the produced compound of Formula (III).

In one embodiment, the glutamine residue Gln is naturally present in a CH2 or CH3 domain of the BA.

In one embodiment, wherein the glutamine residue Gln is introduced to the BA by modifying one or more amino acids.

In one embodiment, wherein the Gln is Q295 or N297Q.

In one embodiment, wherein the transglutaminase is microbial transglutaminase (MTG).

In one embodiment, M is absent, or the M-Dxd has a structure selected from the group consisting of

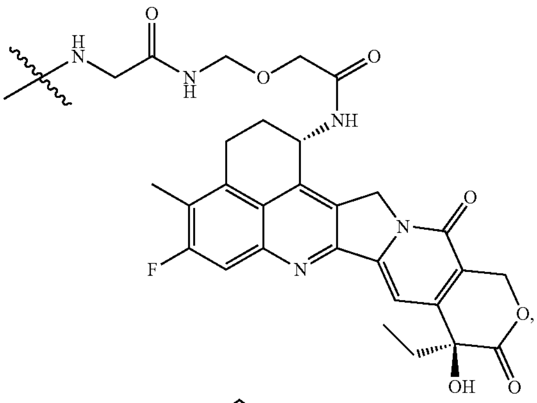

and

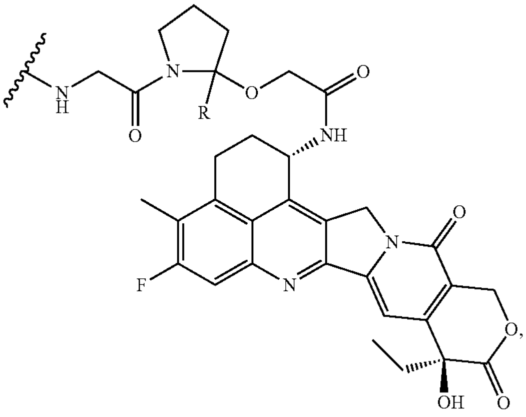

wherein R is a hydrogen or a $C_1$-$C_4$ alkyl, and where ∿∿ represents the point of attachment to L2.

In one embodiment, the compound L2-Dxd has a structure selected from the group consisting of:

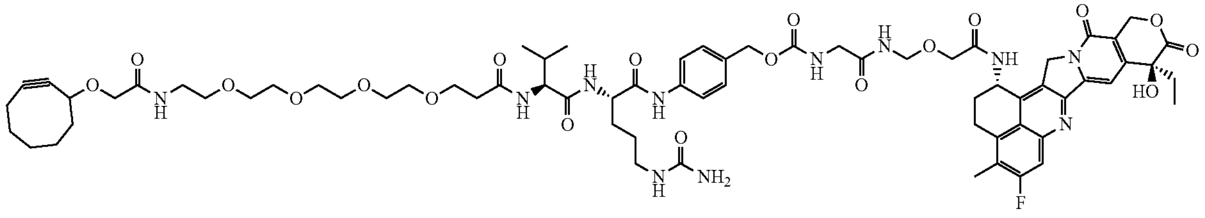

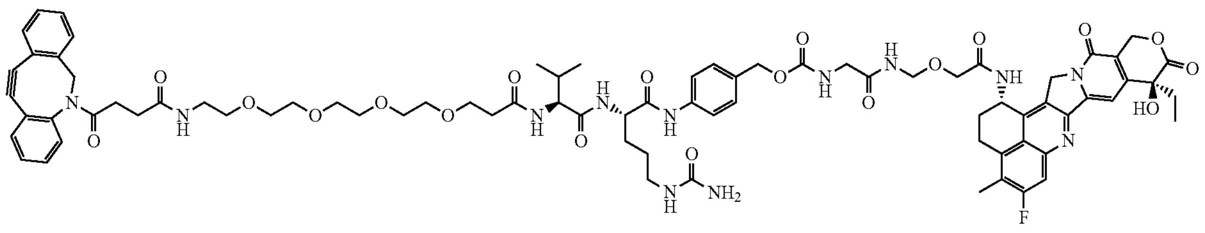

-continued
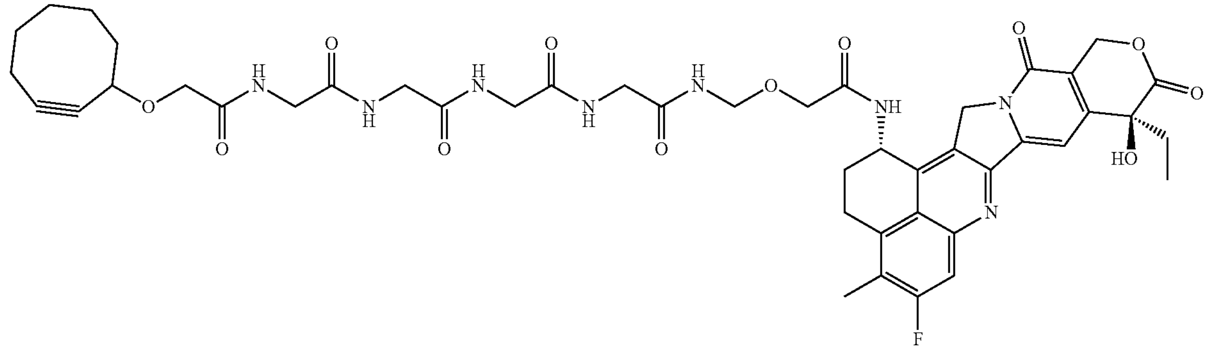
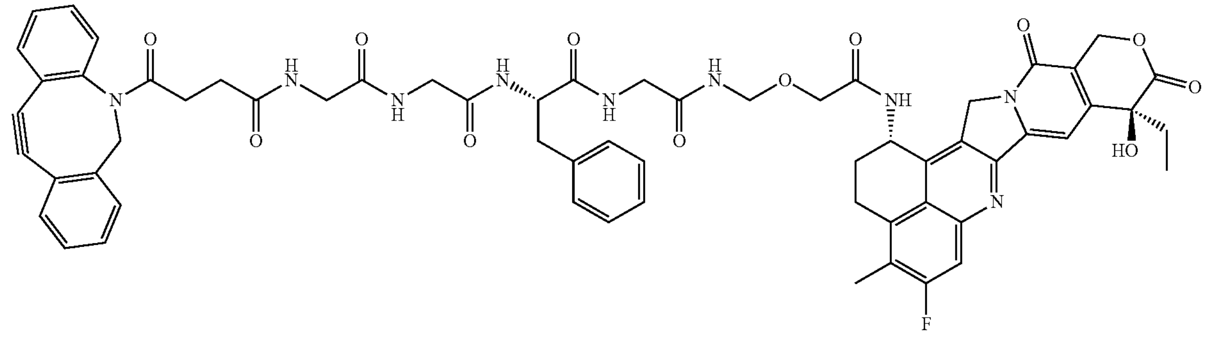
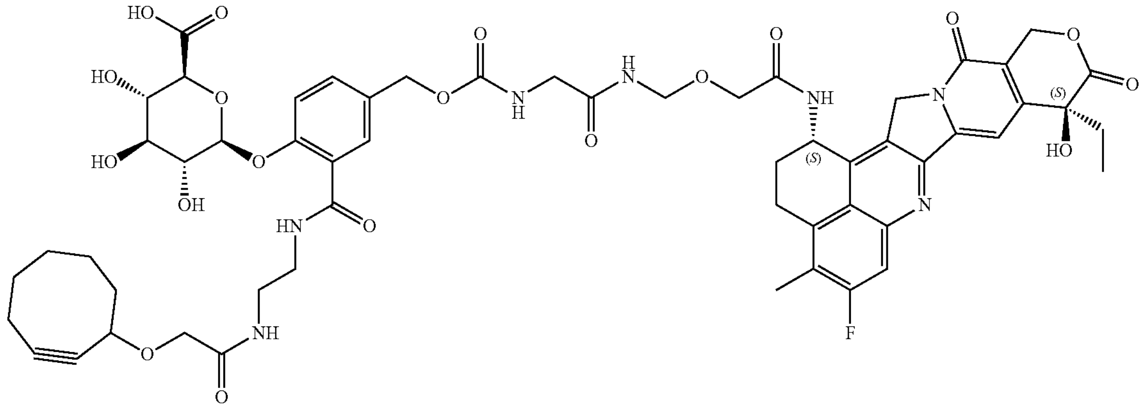
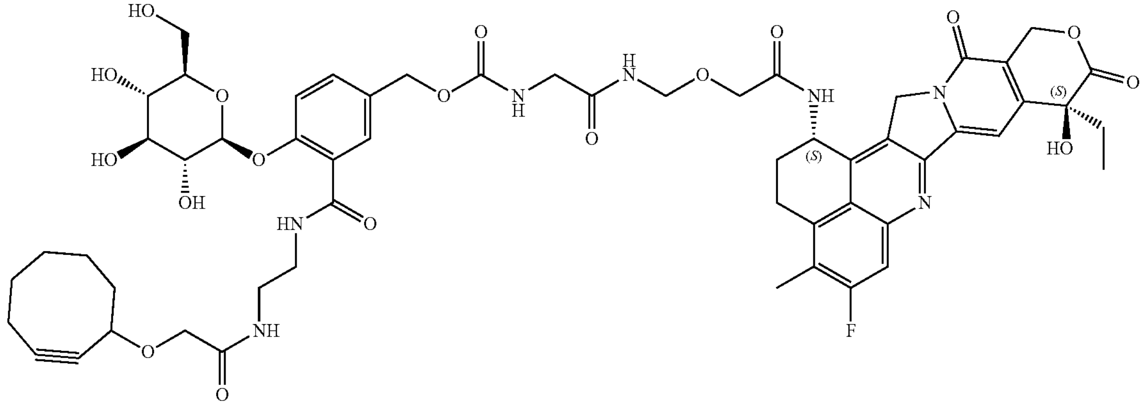

-continued
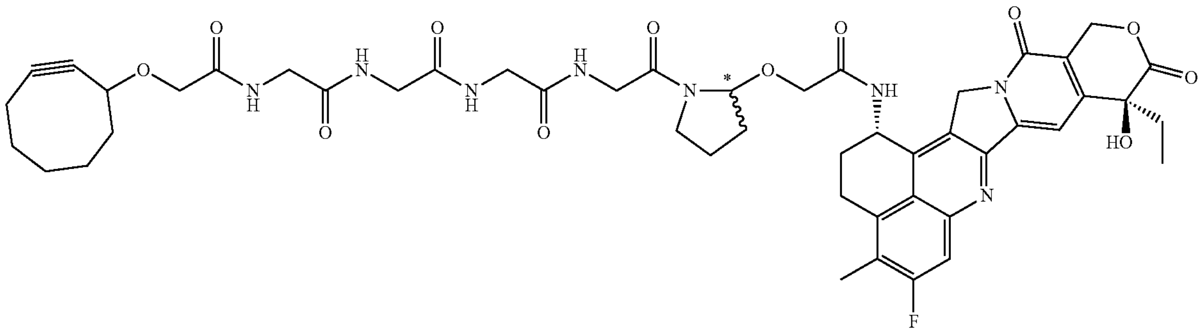
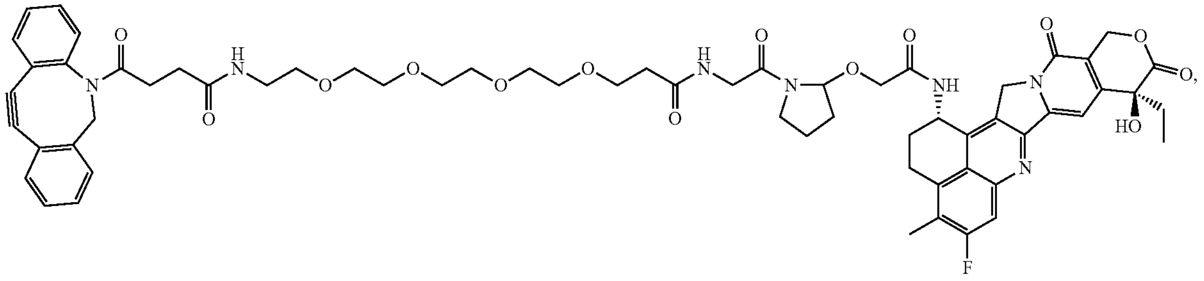
,
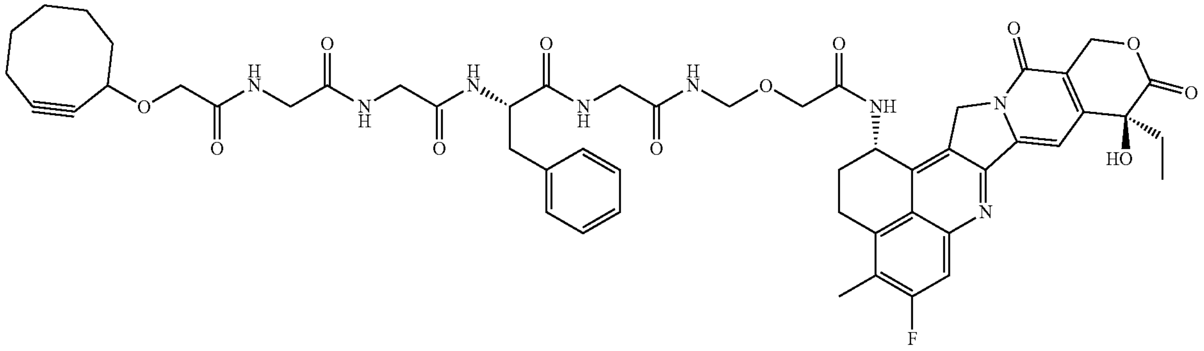
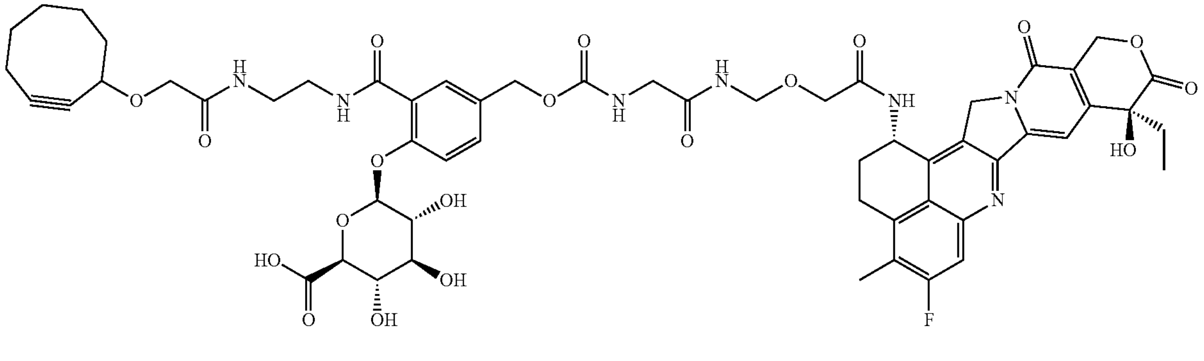
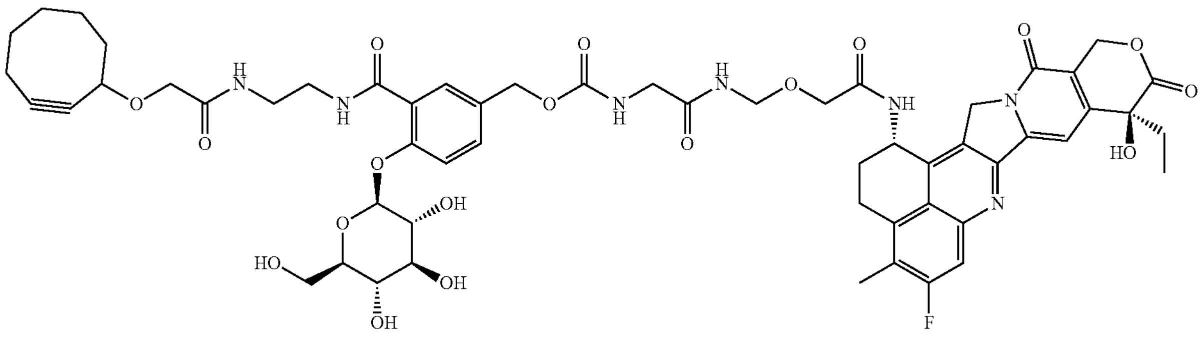

-continued
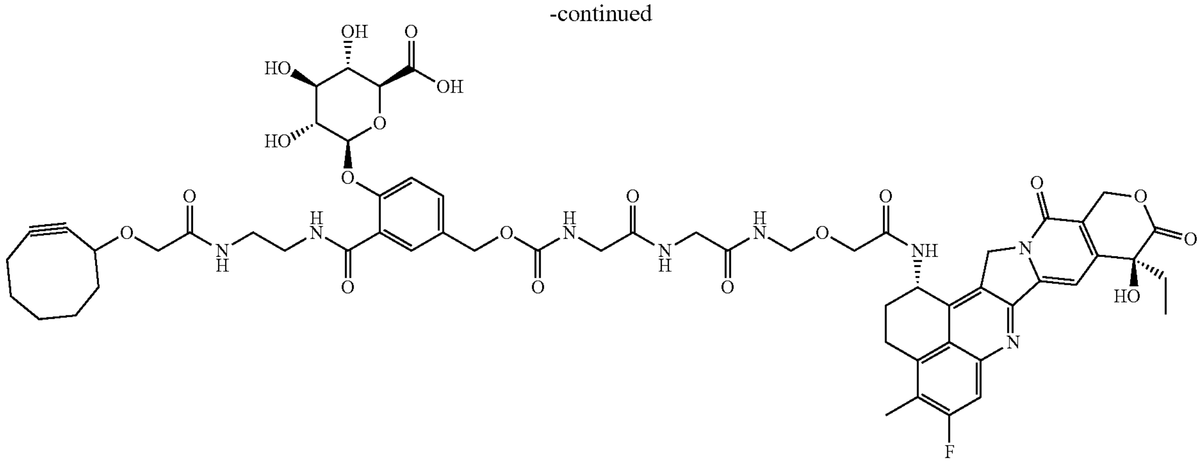
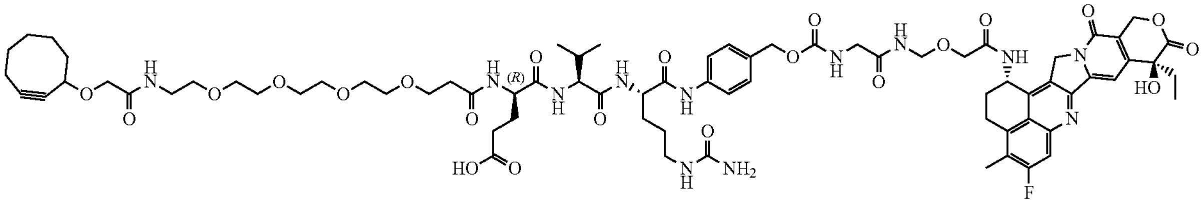
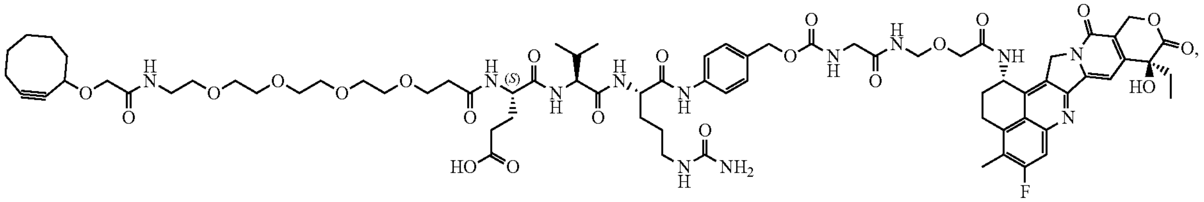
or a pharmaceutically acceptable salt thereof.
In one embodiment, the compound L2-Dxd has a structure selected from the group consisting of:
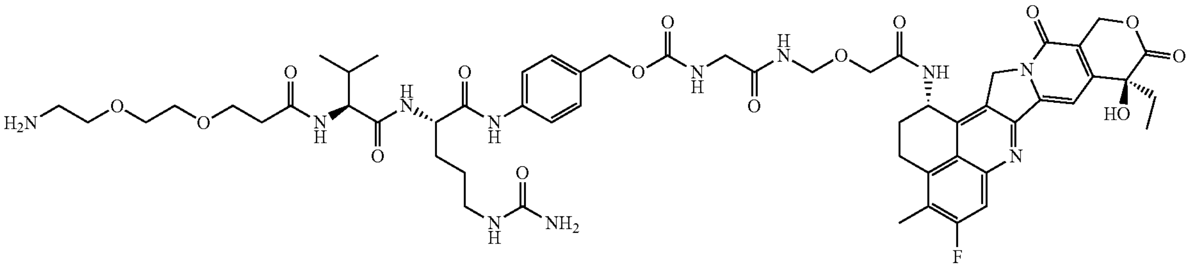
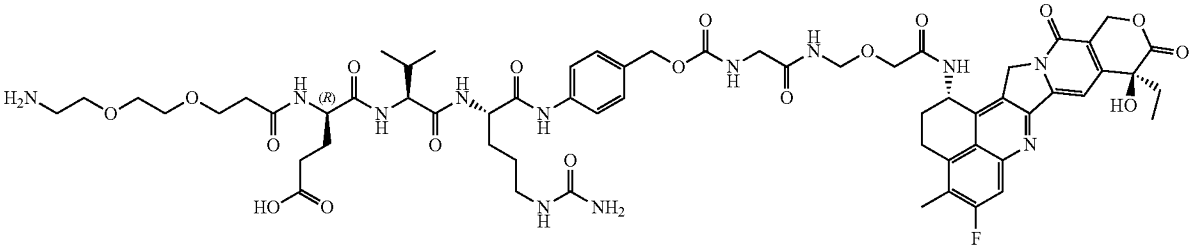

-continued
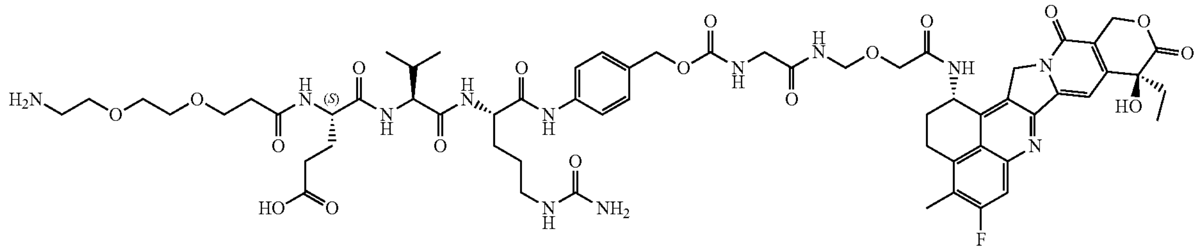
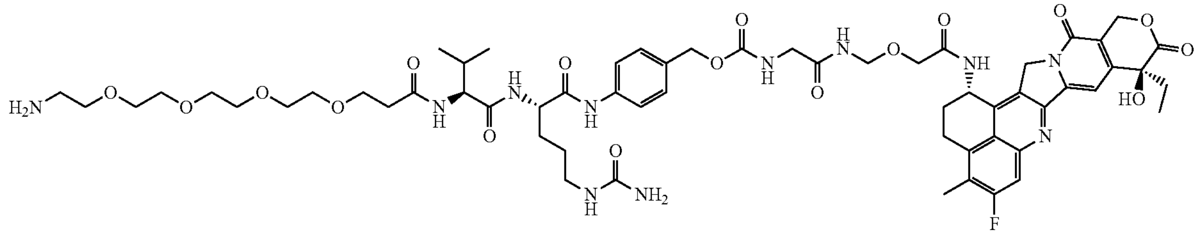
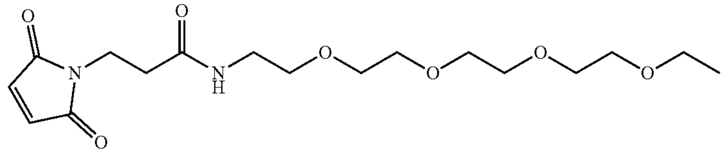
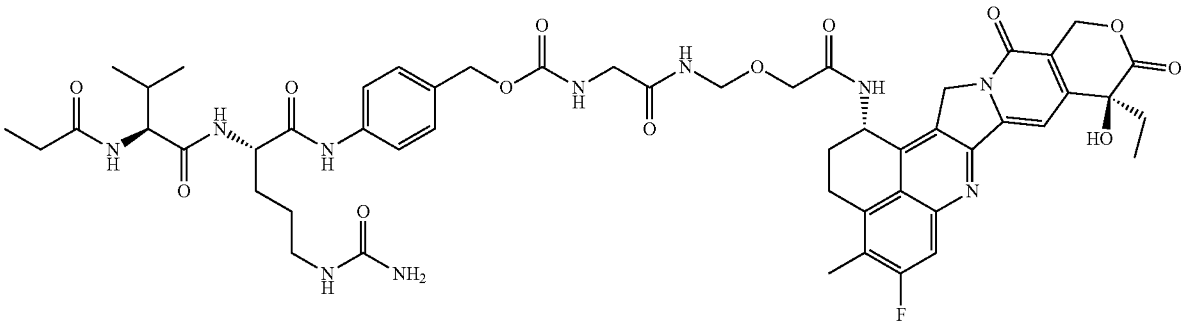
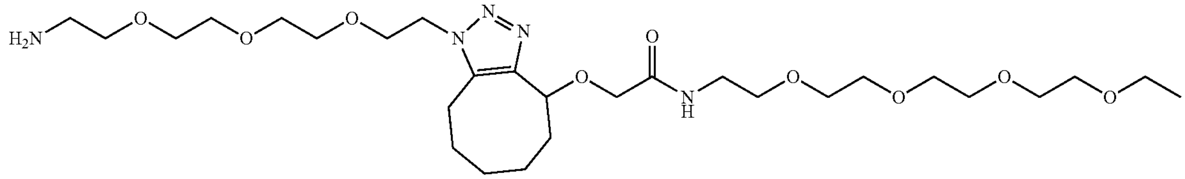
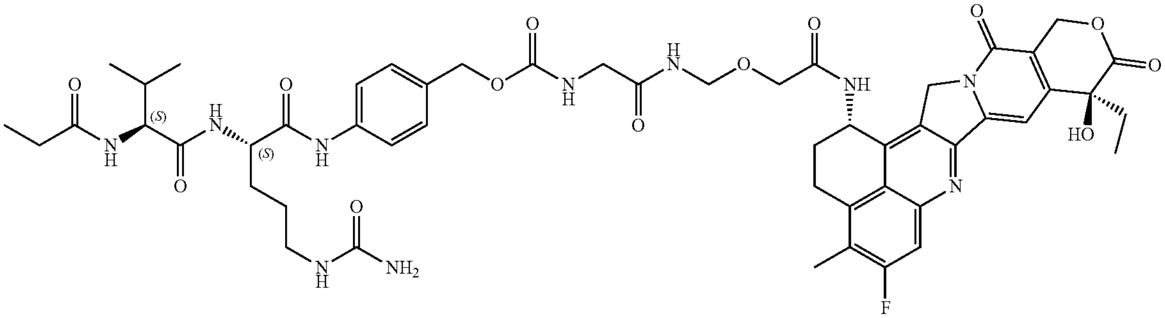
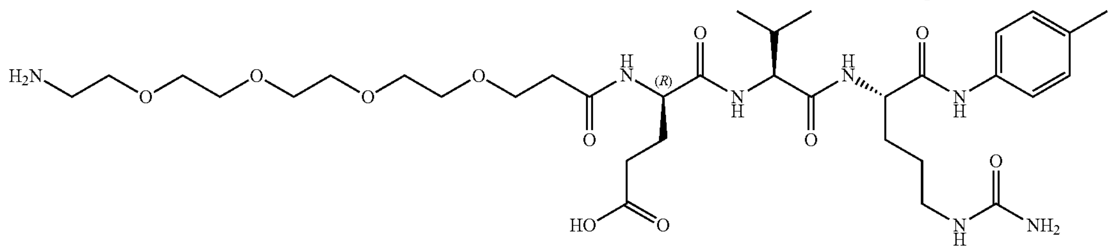

-continued
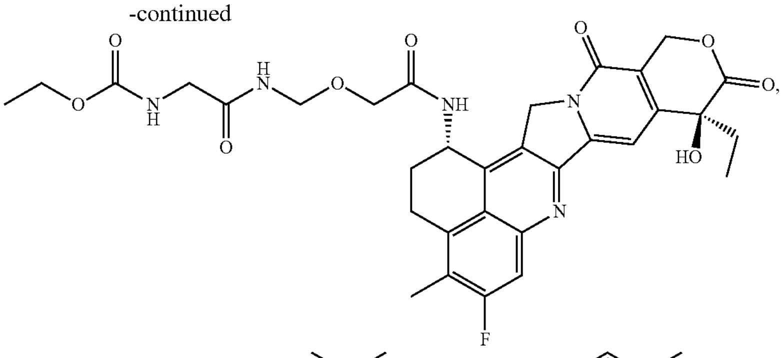
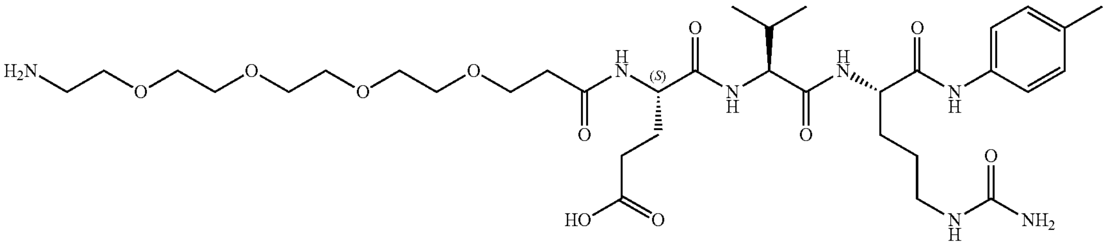
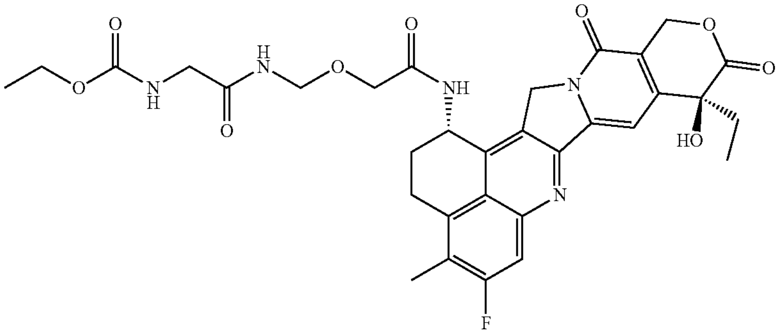
or a pharmaceutically acceptable salt thereof.
In one embodiment, the compound L2-Dxd has a structure selected from the group consisting of:
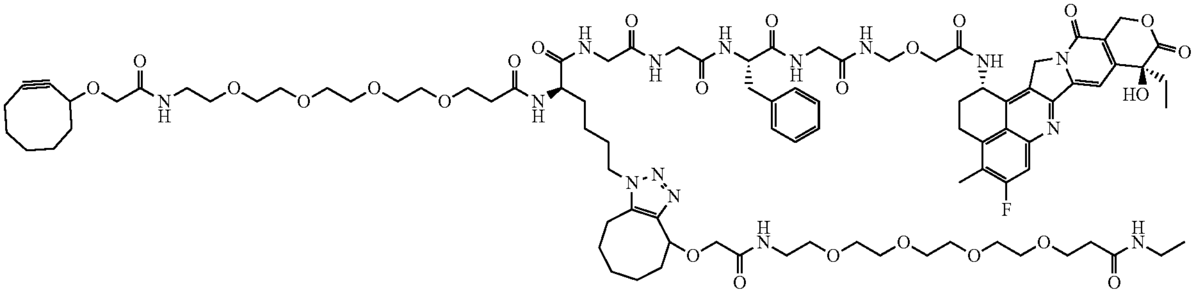
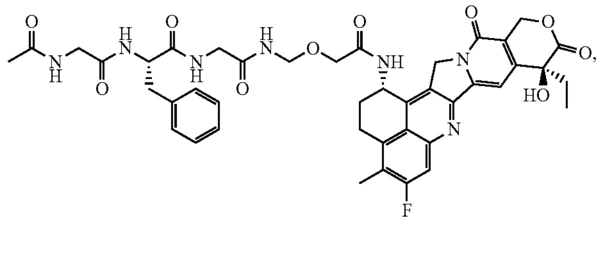

-continued
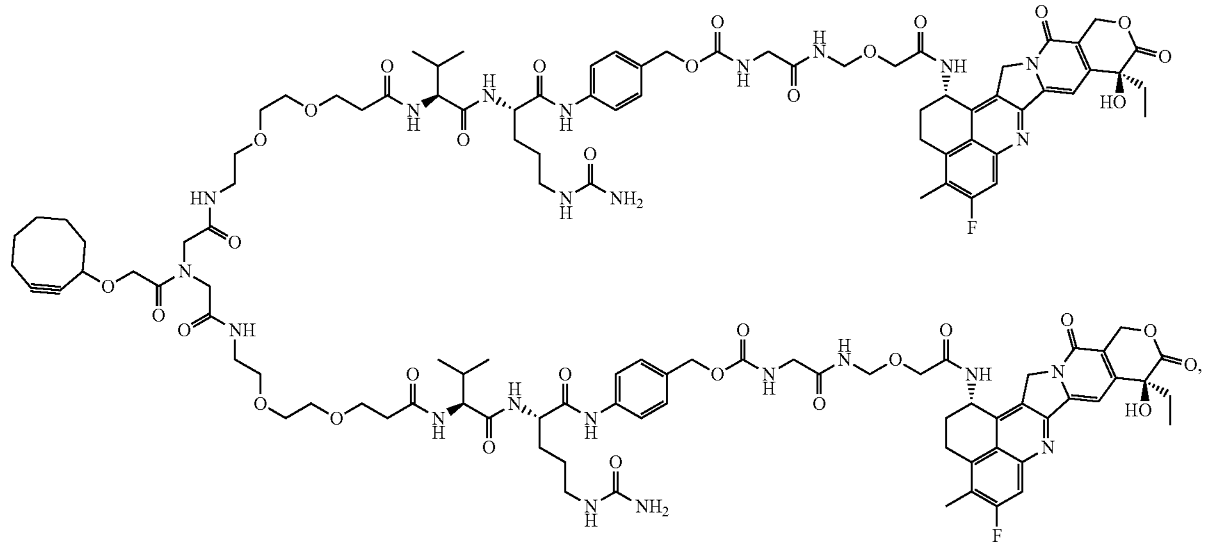
,
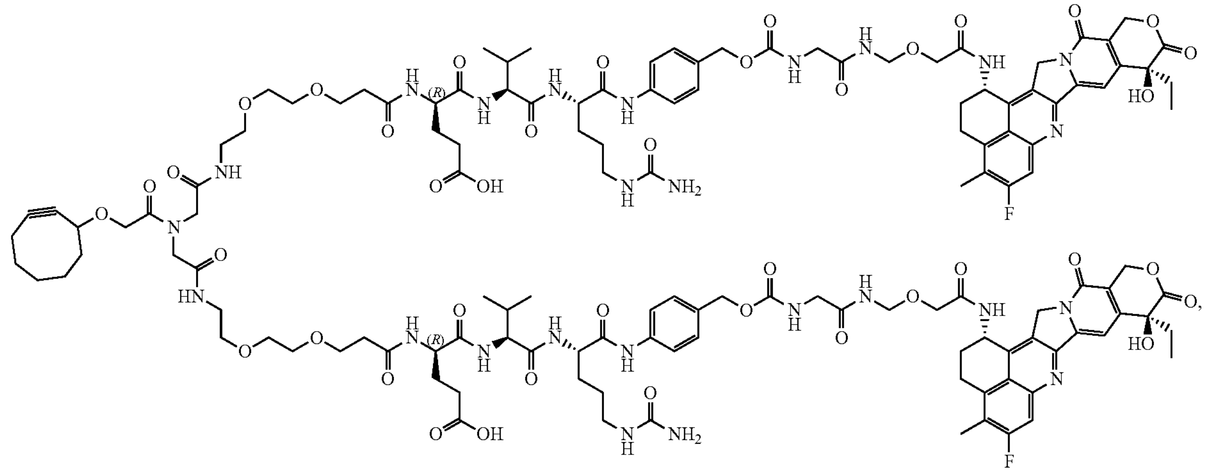
,
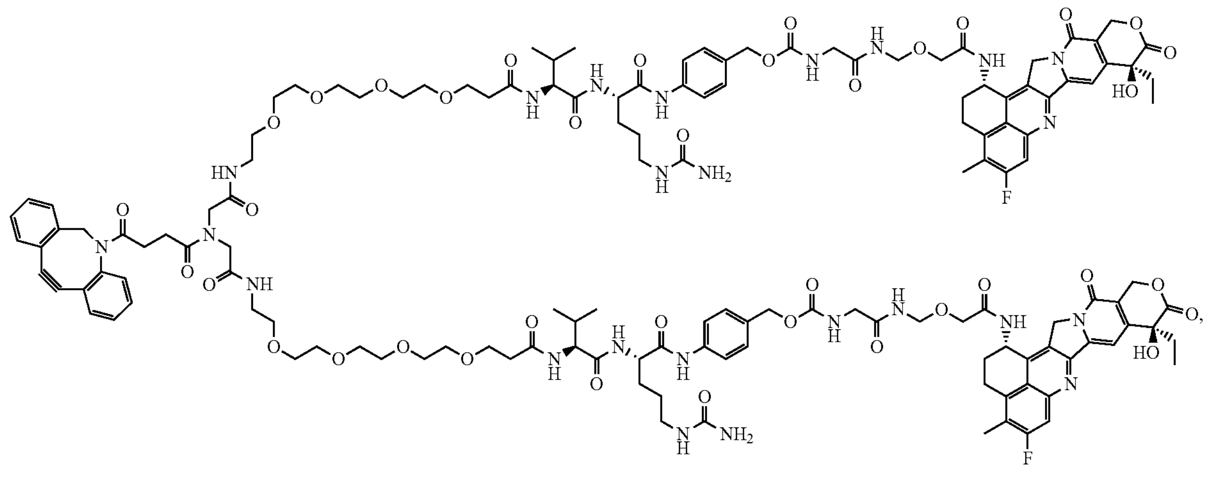
,

-continued
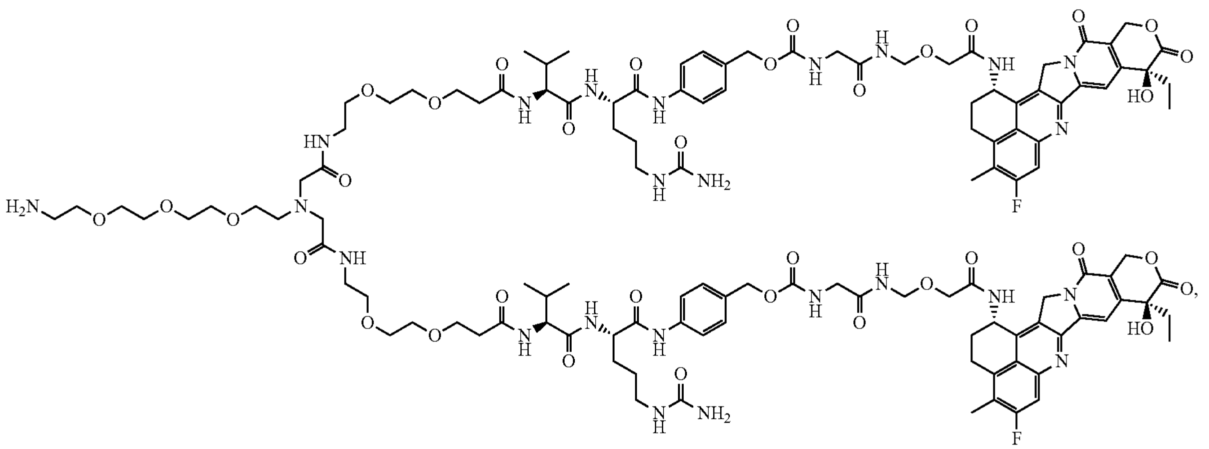
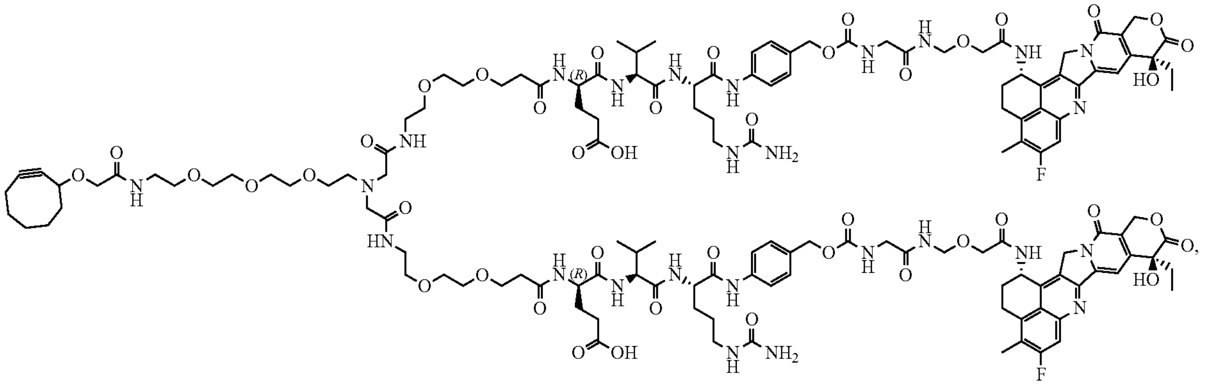
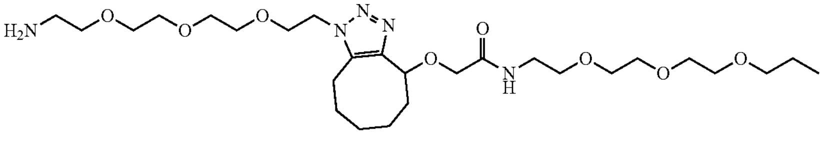
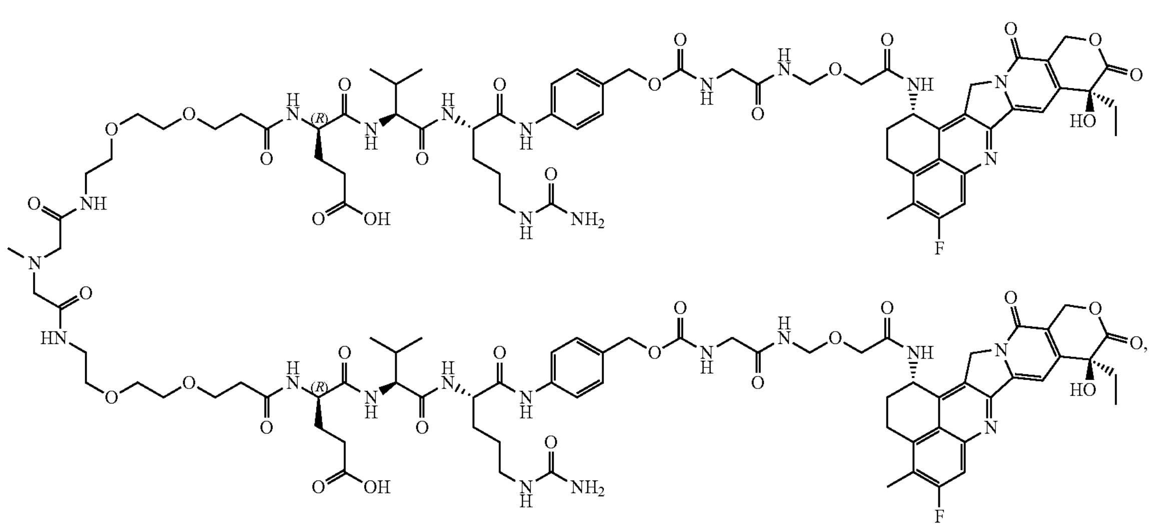

-continued
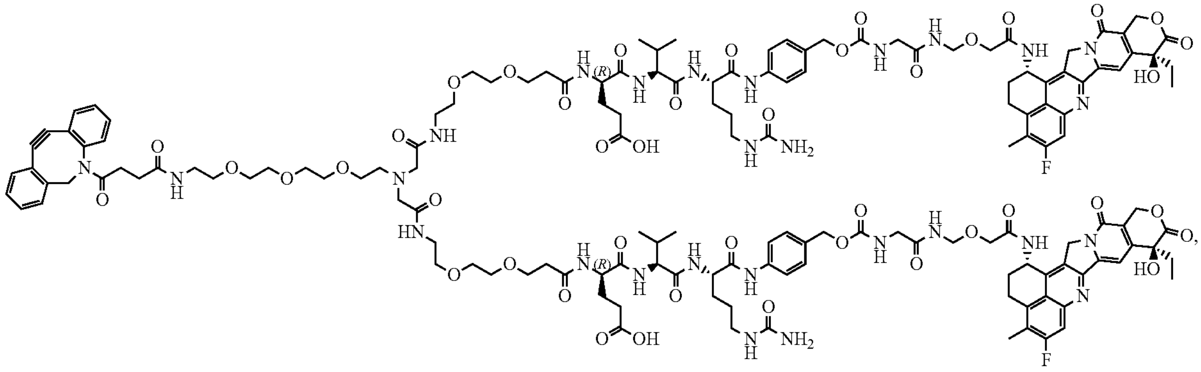
,
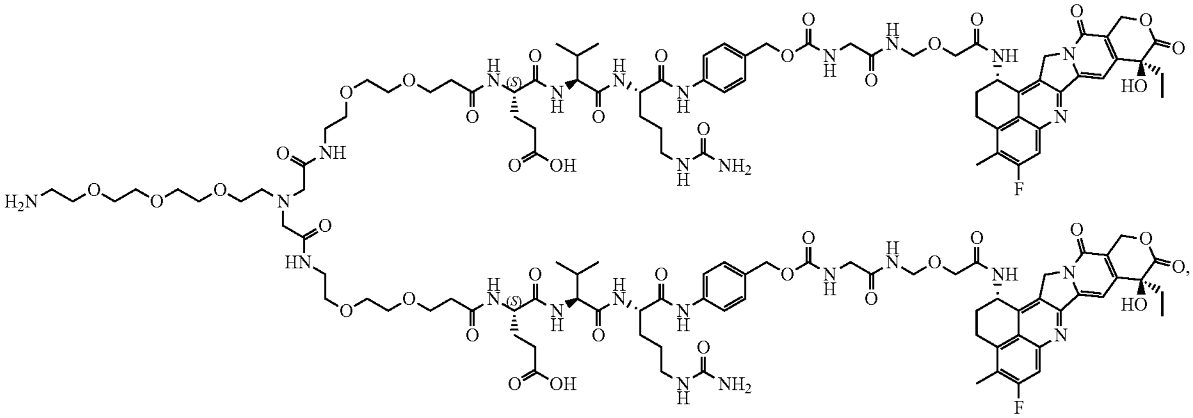
,
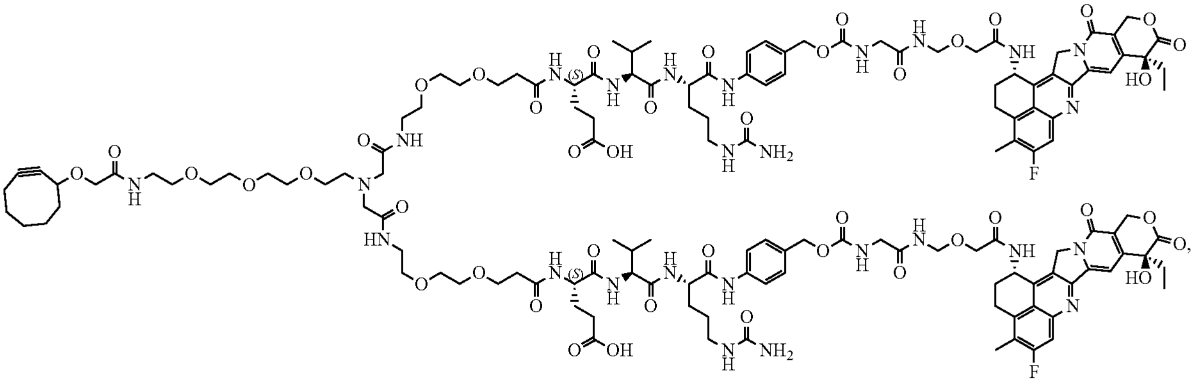
,
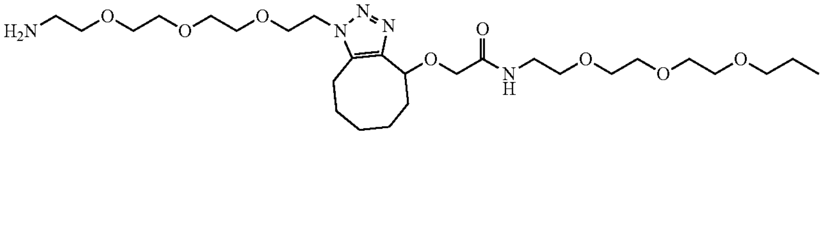

-continued
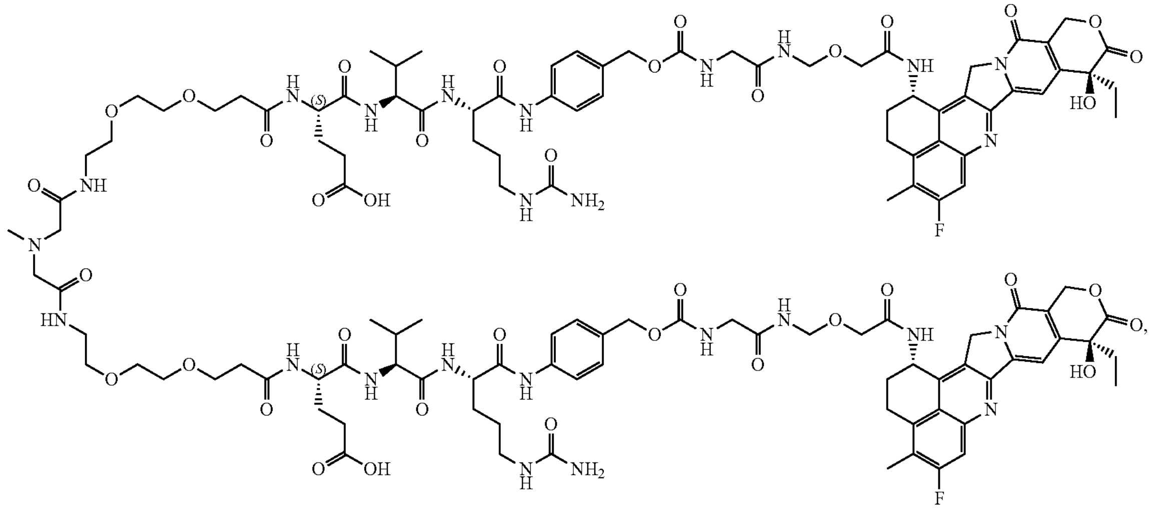
,
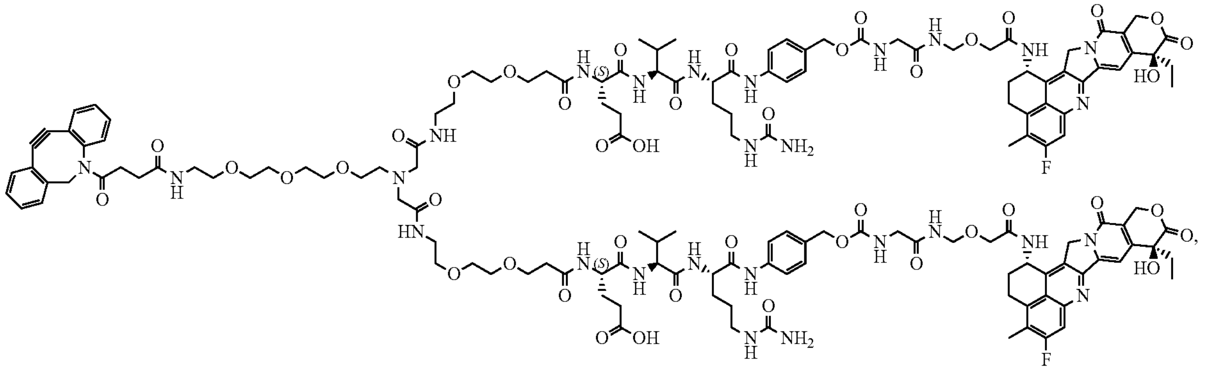
,
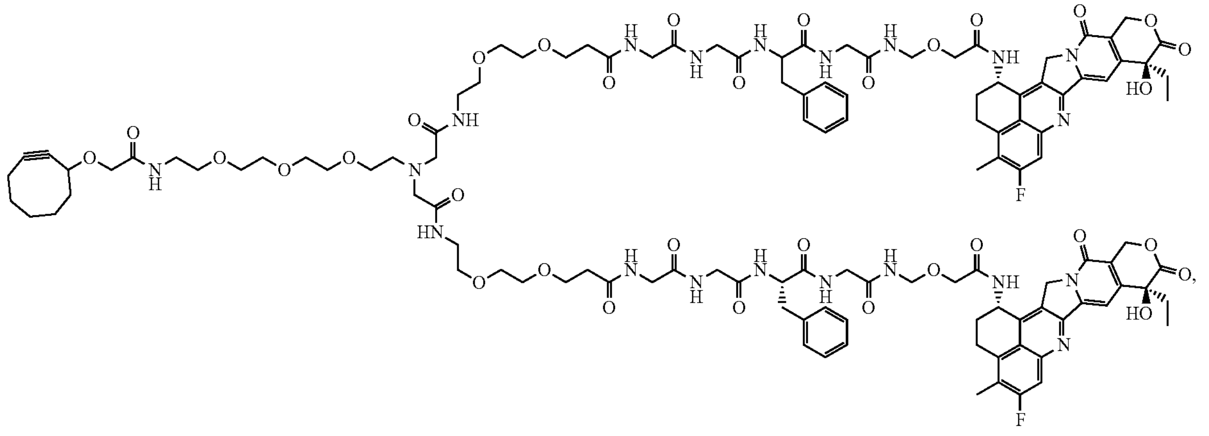
,

-continued
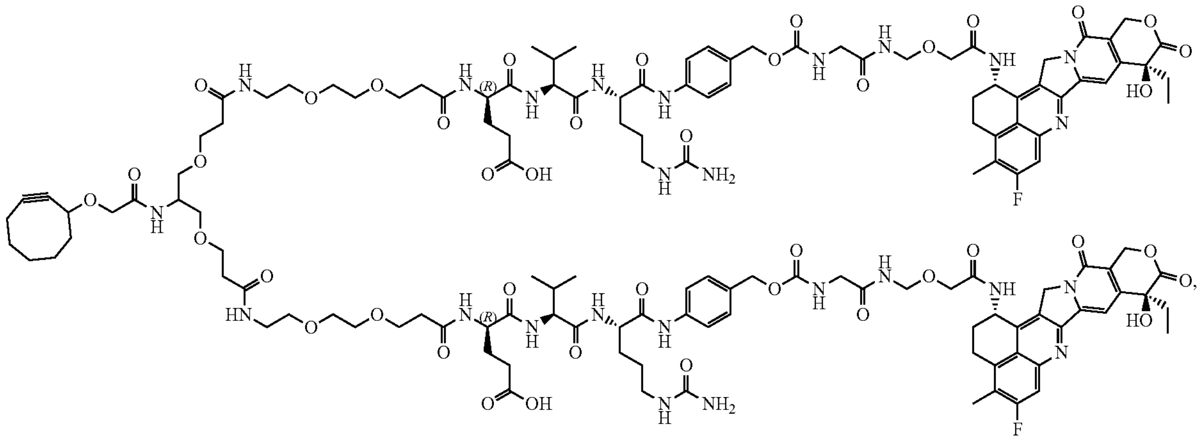
,
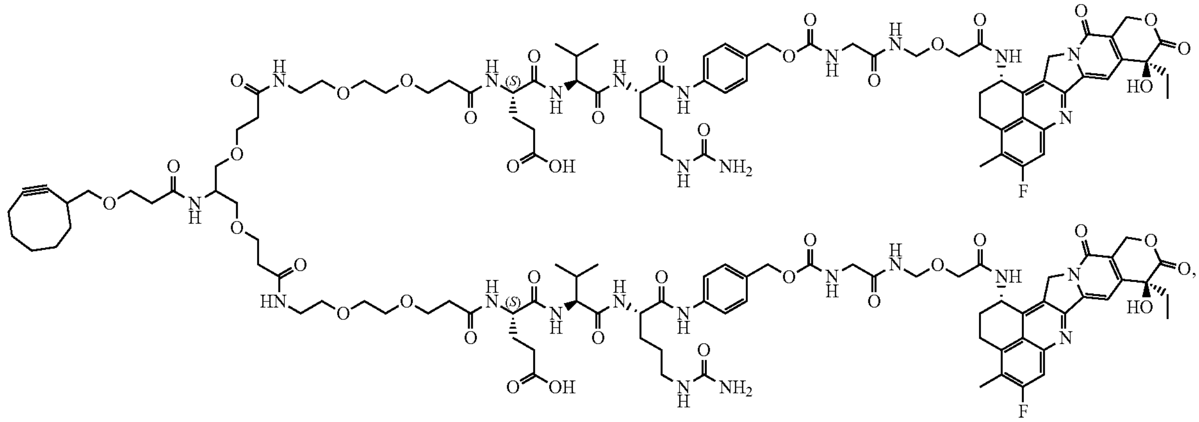
,
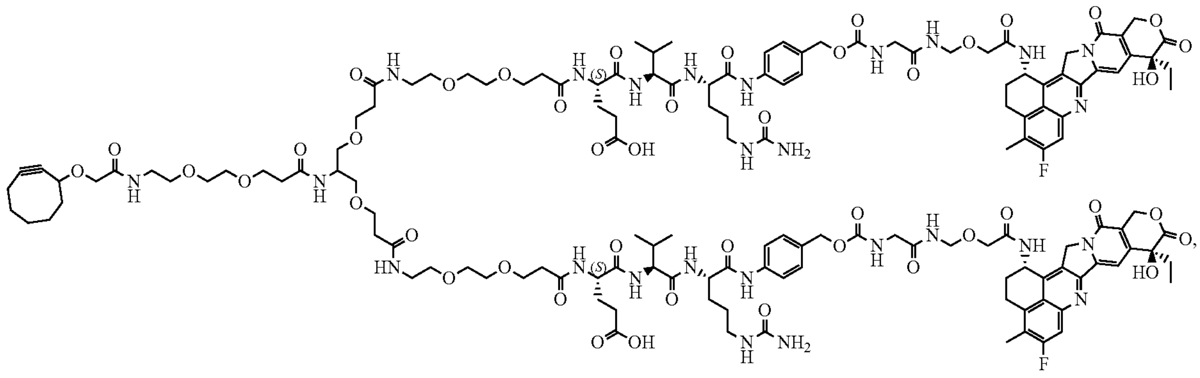
,
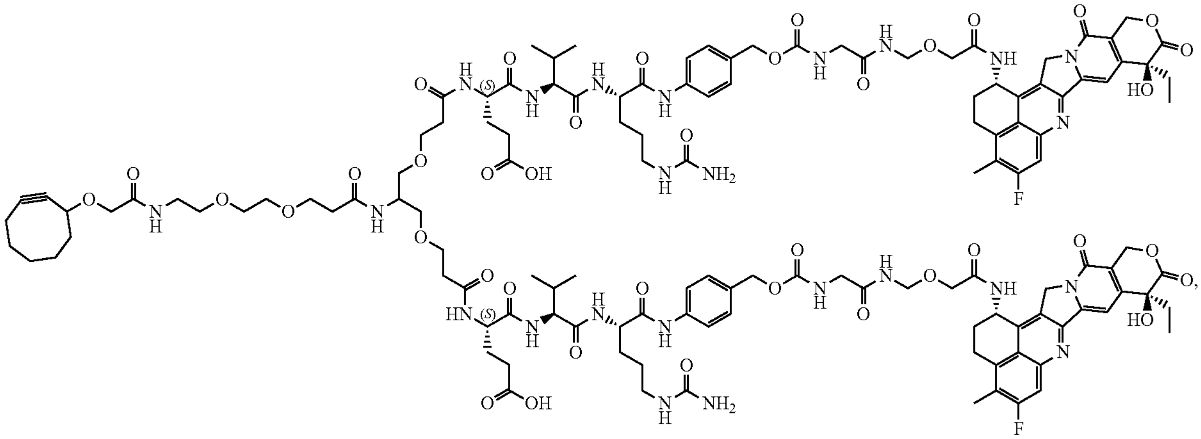
,

-continued
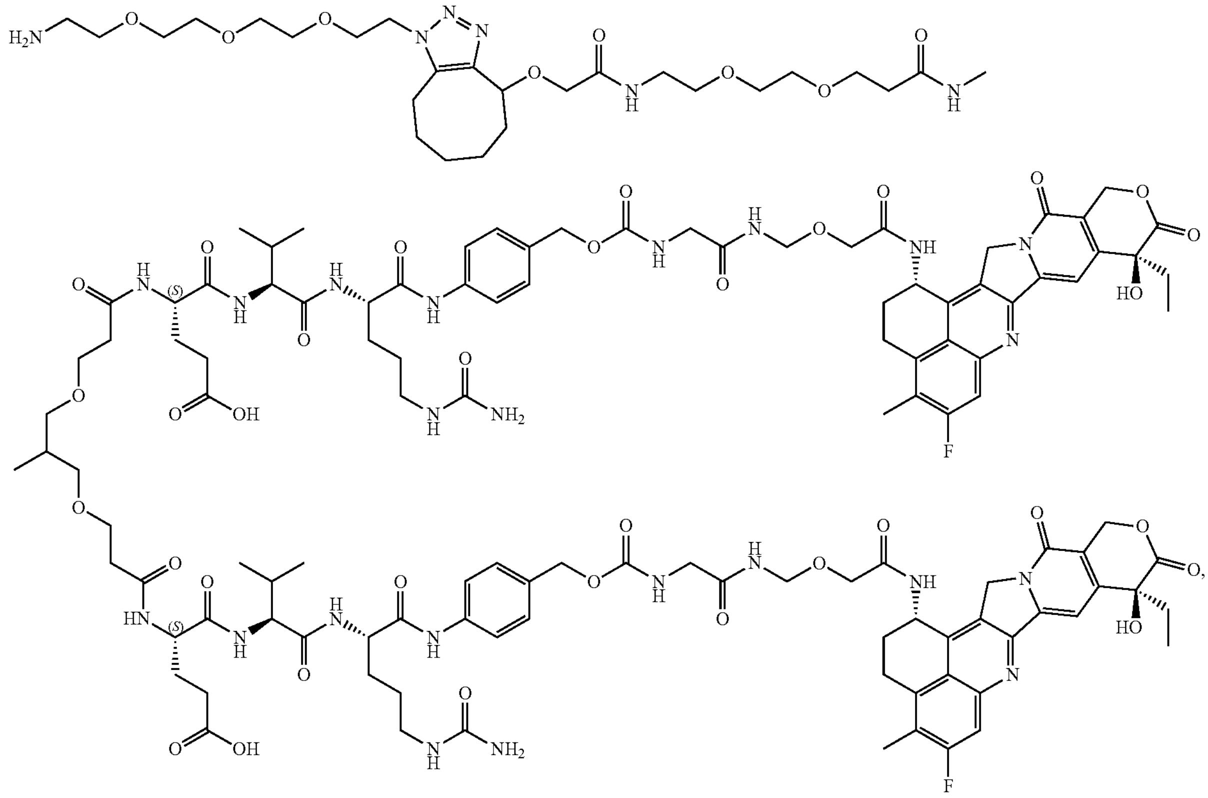
,
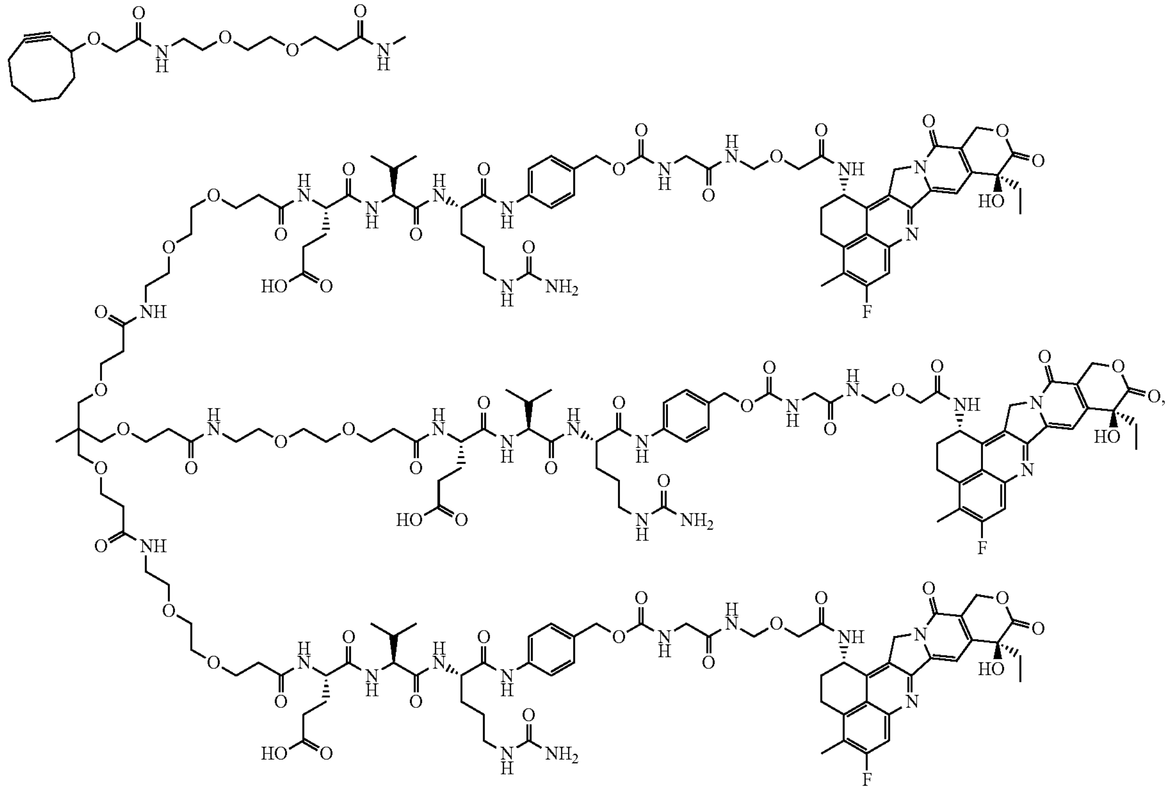
, and
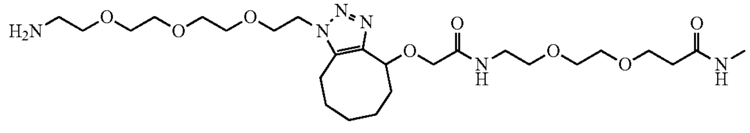

-continued

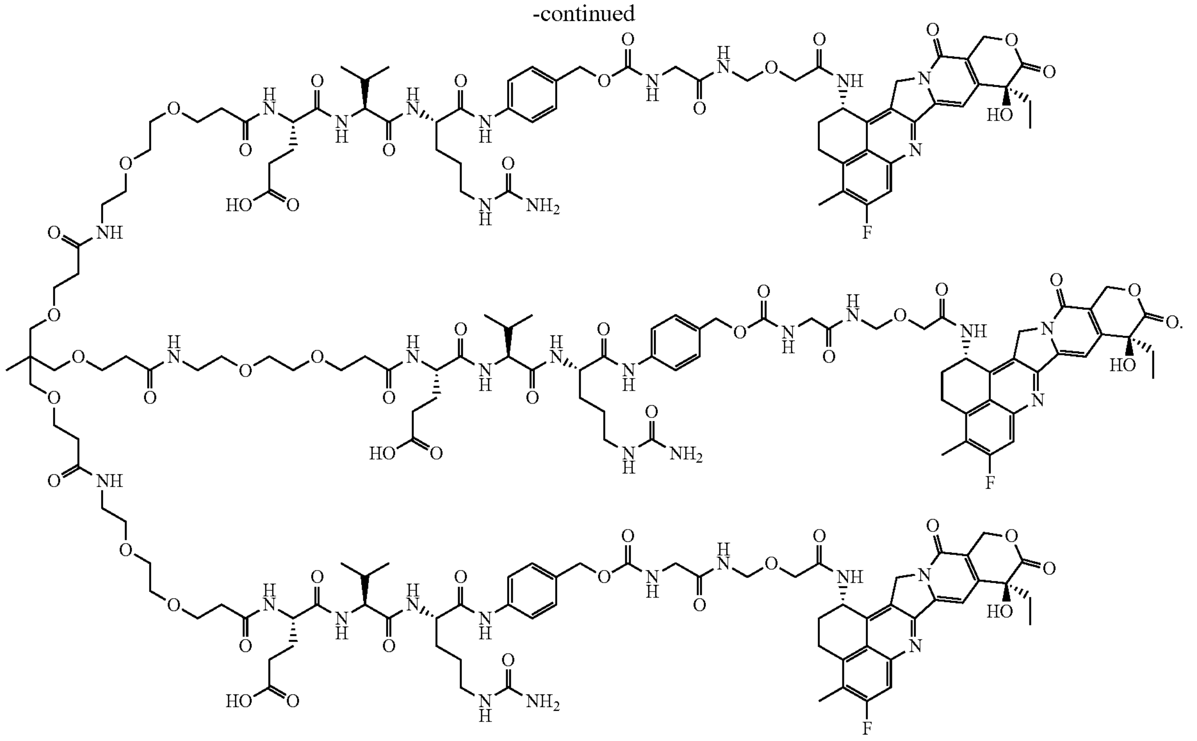

These and other aspects of the present disclosure will become apparent to those skilled in the art after a reading of the following detailed description of the disclosure, including the appended claims.

BRIEF DESCRIPTION OF THE DRAWINGS

FIG. 2A is a schematic of a two-step site-specific generation of Dxd-ADCs with glutamine residues at position 295 having a DAR of 2 times n times m according to an embodiment of the present disclosure. FIG. 2B is a schematic of a two-step site-specific generation of Dxd-ADCs with a glutamine residue at positions 295 and 297 having a DAR of 4 times n times m according to an embodiment of the present disclosure.

FIG. 10 is a matrix illustrating the components of 272 exemplary MET×MET bispecific antibodies disclosed herein. Each numbered cell of the matrix identifies a unique bispecific antibody comprising a "D1" antigen binding domain and a "D2" antigen binding domain, wherein the D1 antigen binding domain comprises the immunoglobulin variable domain (HCVR/LCVR amino acid sequence pair) or CDRs from the corresponding anti-MET antibody listed along the Y-axis, and wherein the D2 antigen binding domain comprises the immunoglobulin variable domain (HCVR/LCVR amino acid sequence pair) or CDRs from the corresponding anti-MET antibody listed along the X-axis.

DETAILED DESCRIPTION

Figure 1:
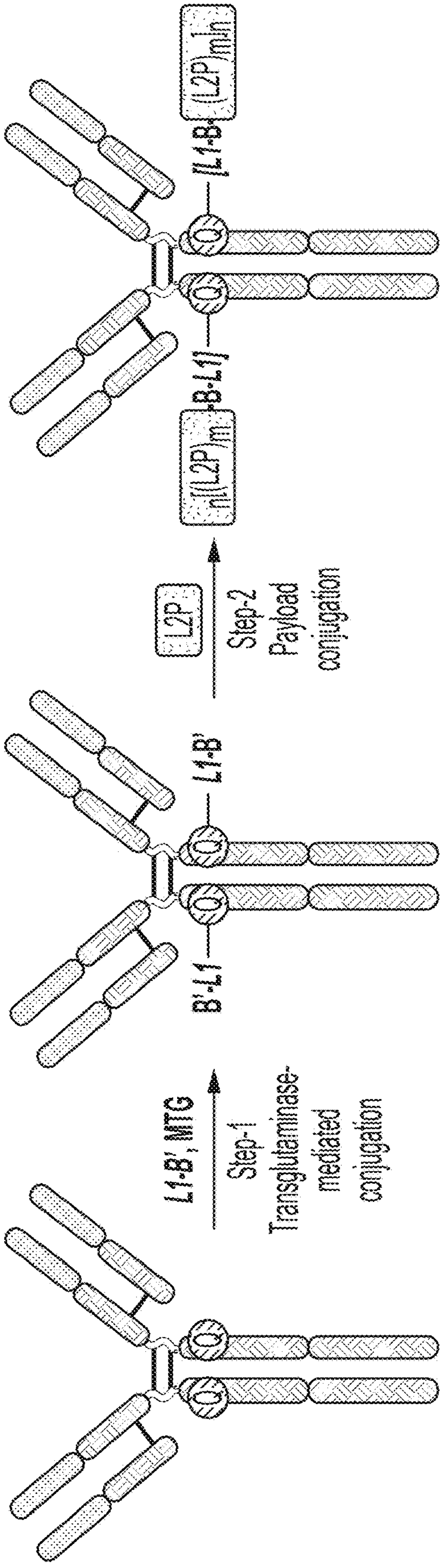
FIG. 1 is a schematic demonstrating two-step site-specific generation of Dxd-ADCs according to an embodiment of the disclosure. The first step is conjugation of one or more first linkers (L1-B') with a glutamine residue on an antibody via a transglutaminase (e.g., MTG)-mediated conjugation reaction. The second step is conjugation of antibody-L1-B to one or more Linker 2-Payloads (1L2P).

Detailed embodiments of the present disclosure are disclosed herein; however, it is to be understood that the disclosed embodiments are merely illustrative of the disclosure that may be embodied in various forms. In addition, each of the examples given in connection with the various embodiments of the disclosure is intended to be illustrative, and not restrictive. Therefore, specific structural and functional details disclosed herein are not to be interpreted as limiting, but merely as a representative basis for teaching one skilled in the art to variously employ the present disclosure.

Definitions

Unless defined otherwise, all technical and scientific terms used herein have the same meaning as commonly understood by one of ordinary skill in the art to which this disclosure belongs.

As used in this specification and the appended claims, the singular forms "a", "an", and "the" include plural references unless the context clearly dictates otherwise. Thus, for example, a reference to "a method" includes one or more methods, and/or steps of the type described herein and/or which will become apparent to those persons skilled in the art upon reading this disclosure.

The terms "treat" or "treatment" of a state, disorder or condition include: (1) preventing, delaying, or reducing the incidence and/or likelihood of the appearance of at least one clinical or sub-clinical symptom of the state, disorder or condition developing in a subject that may be afflicted with or predisposed to the state, disorder or condition but does not yet experience or display clinical or subclinical symptoms of the state, disorder or condition; or (2) inhibiting the state, disorder or condition, i.e., arresting, reducing or delaying the development of the disease or a relapse thereof or at least one clinical or sub-clinical symptom thereof; or (3) relieving the disease, i.e., causing regression of the state, disorder or condition or at least one of its clinical or sub-clinical symptoms. The benefit to a subject to be treated is either statistically significant or at least perceptible to the patient or to the physician. In some embodiments, treatment comprises methods wherein cells are ablated in such manner where disease is indirectly impacted. In certain embodiments, treatment comprises depleting immune cells as a hematopoietic conditioning regimen prior to therapy.

A "subject" or "patient" or "individual" or "animal", as used herein, refers to humans, veterinary animals (e.g., cats, dogs, cows, horses, sheep, pigs, etc.) and experimental animal models of diseases (e.g., mice, rats). In a preferred embodiment, the subject is a human.

As used herein the term "effective" applied to dose or amount refers to that quantity of a compound or pharmaceutical composition that is sufficient to result in a desired activity upon administration to a subject in need thereof. Note that when a combination of active ingredients is administered, the effective amount of the combination may or may not include amounts of each ingredient that would have been effective if administered individually. The exact amount required will vary from subject to subject, depending on the species, age, and general condition of the subject, the severity of the condition being treated, the particular drug or drugs employed, the mode of administration, and the like.

The phrase "pharmaceutically acceptable salt", as used in connection with compositions of the disclosure, refers to any salt suitable for administration to a patient. Suitable salts include, but are not limited to, those disclosed in Berge et al., "Pharmaceutical Salts", *J. Pharm. Sci.,* 1977, 66:1, incorporated herein by reference. Examples of salts include, but are not limited to, acid derived, base derived, organic, inorganic, amine, and alkali or alkaline earth metal salts, including but not limited to calcium salts, magnesium salts, potassium salts, sodium salts, salts of hydrochloric acid, hydrobromic acid, sulfuric acid, nitric acid, phosphoric acid, acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methane sulfonic acid, ethane sulfonic acid, p toluene sulfonic acid, salicylic acid, and the like. In some examples, a payload described herein (e.g., a rifamycin analog described herein) comprises a tertiary amine, where the nitrogen atom in the tertiary amine is the atom through which the payload is bonded to a linker or a linker-spacer. In such instances, bonding to the tertiary amine of the payload yields a quaternary amine in the linker-payload molecule. The positive charge on the quaternary amine can be balanced by a counter ion (e.g., chloro, bromo, iodo, or any other suitably charged moiety such as those described herein).

Ranges can be expressed herein as from "about" or "approximately" one particular value and/or to "about" or "approximately" another particular value. When such a range is expressed, another embodiment includes from the one particular value and/or to the other particular value.

By "comprising" or "containing" or "including" is meant that at least the named compound, element, particle, or method step is present in the composition or article or method, but does not exclude the presence of other compounds, materials, particles, or method steps, even if the other such compounds, material, particles, or method steps have the same function as what is named.

Compounds of the present disclosure include those described generally herein, and are further illustrated by the classes, subclasses, and species disclosed herein. As used herein, the following definitions shall apply unless otherwise indicated. For purposes of this disclosure, the chemical elements are identified in accordance with the Periodic Table of the Elements, CAS version, Handbook of Chemistry and Physics, 75th Ed. Additionally, general principles of organic chemistry are described in "Organic Chemistry", Thomas Sorrell, University Science Books, Sausalito: 1999, and "March's Advanced Organic Chemistry", 5th Ed., Ed.:

Smith, M. B. and March, J., John Wiley & Sons, New York: 2001, the entire contents of which are hereby incorporated by reference.

As used herein, the term "alkyl" is given its ordinary meaning in the art and may include saturated aliphatic groups, including straight-chain alkyl groups, branched-chain alkyl groups, cycloalkyl (alicyclic) groups, alkyl substituted cycloalkyl groups, and cycloalkyl substituted alkyl groups. In certain embodiments, a straight chain or branched chain alkyl has about 1-20 carbon atoms in its backbone (e.g., $C_1$-$C_{20}$ for straight chain, $C_2$-$C_{20}$ for branched chain), and alternatively, about 1-10 carbon atoms, or about 1 to 6 carbon atoms. In some embodiments, a cycloalkyl ring has from about 3-10 carbon atoms in their ring structure where such rings are monocyclic or bicyclic, and alternatively about 5, 6 or 7 carbons in the ring structure. In some embodiments, an alkyl group may be a lower alkyl group, wherein a lower alkyl group comprises 1-4 carbon atoms (e.g., $C_1$-$C_4$ for straight chain lower alkyls).

As used herein, the term "alkenyl" refers to an alkyl group, as defined herein, having one or more double bonds.

As used herein, the term "alkynyl" refers to an alkyl group, as defined herein, having one or more triple bonds.

The term "heteroatom" means one or more of oxygen, sulfur, nitrogen, phosphorus, or silicon (including, any oxidized form of nitrogen, sulfur, phosphorus, or silicon; the quaternized form of any basic nitrogen or; a substitutable nitrogen of a heterocyclic ring.

The term "halogen" means F, Cl, Br, or I; the term "halide" refers to a halogen radical or substituent, namely —F, —Cl, —Br, or —I.

The term "adduct", e.g., "an adduct of group B'" of the present disclosure encompasses any moiety comprising the product of an addition reaction, e.g., an addition reaction of group B', independent of the synthetic steps taken to produce the moiety.

The term "covalent attachment" means formation of a covalent bond, i.e., a chemical bond that involves sharing of one or more electron pairs between two atoms. Covalent bonding may include different interactions, including but not limited to σ-bonding, π-bonding, metal-to-metal bonding, agostic interactions, bent bonds, and three-center two-electron bonds. When a first group is said to be "capable of covalently attaching" to a second group, this means that the first group is capable of forming a covalent bond with the second group, directly or indirectly, e.g., through the use of a catalyst or under specific reaction conditions. Non-limiting examples of groups capable of covalently attaching to each other may include, e.g., an amine and a carboxylic acid (forming an amide bond), a diene and a dienophile (via a Diels-Alder reaction), and an azide and an alkyne (forming a triazole via a 1,3-cycloaddition reaction).

As described herein, compounds of the disclosure may contain "optionally substituted" moieties. In general, the term "substituted," whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent selected from a specified group, the substituent may be either the same or different at every position. Combinations of substituents envisioned by this disclosure are preferably those that result in the formation of stable or chemically feasible compounds. The term "stable," as used herein, refers to compounds that are not substantially altered when subjected to conditions to allow for their production, detection, and, in certain embodiments, their recovery, purification, and use for one or more of the purposes disclosed herein.

Unless otherwise stated, structures depicted herein are also meant to include all isomeric (e.g., enantiomeric, diastereomeric, and geometric (or conformational)) forms of the structure; for example, the R and S configurations for each asymmetric center, (Z) and (E) double bond isomers, and (Z) and (E) conformational isomers. Therefore, single stereochemical isomers as well as enantiomeric, diastereomeric, and geometric (or conformational) mixtures of the present compounds are within the scope of the disclosure.

Unless otherwise stated, all tautomeric forms of the compounds of the disclosure are within the scope of the disclosure.

Additionally, unless otherwise stated, structures depicted herein are also meant to include compounds that differ only in the presence of one or more isotopically enriched atoms. For example, compounds having the present structures except for the replacement of hydrogen by deuterium or tritium, or the replacement of a carbon by a $^{11}C$- or $^{13}C$- or $^{14}C$-enriched carbon are within the scope of this disclosure.

It is also to be understood that the mention of one or more method steps does not preclude the presence of additional method steps or intervening method steps between those steps expressly identified. Similarly, it is also to be understood that the mention of one or more components in a device or system does not preclude the presence of additional components or intervening components between those components expressly identified.

Unless otherwise stated, all crystalline forms of the compounds of the disclosure and salts thereof are also within the scope of the disclosure. The compounds of the disclosure may be isolated in various amorphous and crystalline forms, including without limitation forms which are anhydrous, hydrated, non-solvated, or solvated. Example hydrates include hemihydrates, monohydrates, dihydrates, and the like. In some embodiments, the compounds of the disclosure are anhydrous and non-solvated. By "anhydrous" is meant that the crystalline form of the compound contains essentially no bound water in the crystal lattice structure, i.e., the compound does not form a crystalline hydrate.

As used herein, "crystalline form" is meant to refer to a certain lattice configuration of a crystalline substance. Different crystalline forms of the same substance typically have different crystalline lattices (e.g., unit cells) which are attributed to different physical properties that are characteristic of each of the crystalline forms. In some instances, different lattice configurations have different water or solvent content. The different crystalline lattices can be identified by solid state characterization methods such as by X-ray powder diffraction (PXRD). Other characterization methods such as differential scanning calorimetry (DSC), thermogravimetric analysis (TGA), dynamic vapor sorption (DVS), solid state NMR, and the like further help identify the crystalline form as well as help determine stability and solvent/water content.

Crystalline forms of a substance include both solvated (e.g., hydrated) and non-solvated (e.g., anhydrous) forms. A hydrated form is a crystalline form that includes water in the crystalline lattice. Hydrated forms can be stoichiometric hydrates, where the water is present in the lattice in a certain water/molecule ratio such as for hemihydrates, monohydrates, dihydrates, etc. Hydrated forms can also be non-stoichiometric, where the water content is variable and dependent on external conditions such as humidity.

In some embodiments, the compounds of the disclosure are substantially isolated. By "substantially isolated" is meant that a particular compound is at least partially isolated from impurities. For example, in some embodiments a compound of the disclosure comprises less than about 50%, less than about 40%, less than about 30%, less than about 20%, less than about 15%, less than about 10%, less than about 5%, less than about 2.5%, less than about 1%, or less than about 0.5% of impurities. Impurities generally include anything that is not the substantially isolated compound including, for example, other crystalline forms and other substances.

Certain groups, moieties, substituents, and atoms are depicted with a wavy line. The wavy line can intersect or cap a bond or bonds. The wavy line indicates the atom through which the groups, moieties, substituents, or atoms are bonded. For example, a phenyl group that is substituted with a propyl group depicted as:

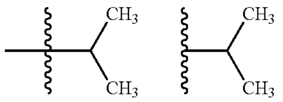

has the following structure:

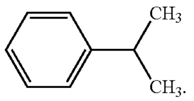

The expression "HER2" or "human epidermal growth factor receptor 2" refers to a member of the human epidermal growth factor receptor family. The protein is also known as NEU; NGL; HER2; TKR1; CD340; HER-2; MLN 19; HER-2/neu. HER2 can refer to the amino acid sequence as set forth in NCBI accession No. NP_004439.2. Amplification or over-expression of this oncogene has been shown to play an important role in the development and progression of certain aggressive types of breast cancer. In recent years the protein has become an important biomarker and target of therapy for approximately 30% of breast cancer patient. All references to proteins, polypeptides and protein fragments herein are intended to refer to the human version of the respective protein, polypeptide or protein fragment unless explicitly specified as being from a non-human species. Thus, the expression "HER2" means human HER2 unless specified as being from a non-human species, e.g., "mouse HER2," "monkey HER2," etc.

The phrase "an antibody that binds HER2" or an "anti-HER2 antibody" includes antibodies and antigen-binding fragments thereof that specifically recognize HER2.

The phrase an "anti-HER2/HER2" antibody, e.g., an "anti-HER2/HER2 bispecific antibody" includes antibodies and antigen-binding fragments thereof that specifically recognize two different HER2 epitopes. In some embodiments, bispecific antibodies and antigen-binding fragments thereof comprise a first antigen-binding domain (D1) which specifically binds a first epitope of human HER2 and a second antigen-binding domain (D2) which specifically binds a second epitope of human HER2.

The expression "STEAP2," as used herein, refers to six-transmembrane epithelial antigen of prostate 2. STEAP2 is an integral, six-transmembrane-spanning protein that is highly expressed in prostate epithelial cells and is a cell-surface marker for prostate cancer, for example STEAP2 was found to be expressed in significant levels on an LNCaP prostate cell line (Porkka, et al. *Lab Invest* 2002, 82:1573-1582). STEAP2 (UniProtKB/Swiss-Prot: Q8NFT2.3) is a 490-amino acid protein encoded by STEAP2 gene located at the chromosomal region 7q21 in humans, see e.g., the amino acid sequence of human STEAP2 as set forth in Tables 1 and 2.

As used herein, "an antibody that binds STEAP2" or an "anti-STEAP2 antibody" includes antibodies and antigen-binding fragments thereof that specifically recognize STEAP2.

The phrase "an antibody that binds MET" or an "anti-MET antibody" includes antibodies and antigen-binding fragments thereof that specifically recognize MET. The expressions "MET," "c-Met," and the like, as used herein, refer to the human membrane spanning receptor tyrosine kinase.

The phrase an "anti-MET/MET" antibody, e.g., an "anti-MET/MET bispecific antibody" includes antibodies and antigen-binding fragments thereof that specifically recognize two different MET epitopes. In some embodiments, bispecific antibodies and antigen-binding fragments thereof comprise a first antigen-binding domain (D1) which specifically binds a first epitope of human MET and a second antigen-binding domain (D2) which specifically binds a second epitope of human MET.

All amino acid abbreviations used in this disclosure are those accepted by the United States Patent and Trademark Office as set forth in 37 C.F.R. § 1.822 (B)(J).

The term "protein" means any amino acid polymer having more than about 20 amino acids covalently linked via amide bonds. As used herein, "protein" includes biotherapeutic proteins, recombinant proteins used in research or therapy, trap proteins and other Fc-fusion proteins, chimeric proteins, antibodies, monoclonal antibodies, human antibodies, bispecific antibodies, antibody fragments, nanobodies, recombinant antibody chimeras, scFv fusion proteins, cytokines, chemokines, peptide hormones, and the like. Proteins can be produced using recombinant cell-based production systems, such as the insect bacculovirus system, yeast systems (e.g., *Pichia* sp.), mammalian systems (e.g., CHO cells and CHO derivatives like CHO-K1 cells).

All references to proteins, polypeptides and protein fragments herein are intended to refer to the human version of the respective protein, polypeptide or protein fragment unless explicitly specified as being from a non-human species. Thus, the expression "STEAP2" means human STEAP2 unless specified as being from a non-human species, e.g., "mouse STEAP2," "monkey STEAP2," etc.

The amino acid sequence of an antibody can be numbered using any known numbering schemes, including those described by Kabat et al., ("Kabat" numbering scheme); Al-Lazikani et al., 1997, *J. Mol. Biol.*, 273:927-948 ("Chothia" numbering scheme); MacCallum et al., 1996, *J. Mol. Biol.* 262:732-745 ("Contact" numbering scheme); Lefranc et al., Dev. Comp. *Immunol.*, 2003, 27:55-77 ("IMGT" numbering scheme); and Honegge and Pluckthun, *J. Mol. Biol.*, 2001, 309:657-70 ("AHo" numbering scheme). Unless otherwise specified, the numbering scheme used herein is the Kabat numbering scheme. However, selection of a numbering scheme is not intended to imply differences in sequences where they do not exist, and one of skill in the art can readily confirm a sequence position by examining the amino acid sequence of one or more antibodies. Unless stated otherwise, the "EU numbering scheme" is generally used when referring to a residue in an antibody heavy chain constant region (e.g., as reported in Kabat et al., supra).

The term "glutaminyl-modified antibody" refers to an antibody with at least one covalent linkage from a glutamine side chain to a primary amine compound of the present disclosure. In particular embodiments, the primary amine compound is linked through an amide linkage on the glutamine side chain. In certain embodiments, the glutamine is an endogenous glutamine. In other embodiments, the glutamine is an endogenous glutamine made reactive by polypeptide engineering (e.g., via amino acid deletion, insertion, substitution, or mutation on the polypeptide). In additional embodiments, the glutamine is polypeptide engineered with an acyl donor glutamine-containing tag (e.g., glutamine-containing peptide tags, Q-tags or TGase recognition tag).

The term "TGase recognition tag" refers to a sequence of amino acids comprising an acceptor glutamine residue and that when incorporated into (e.g., appended to) a polypeptide sequence, under suitable conditions, is recognized by a TGase and leads to cross-linking by the TGase through a reaction between an amino acid side chain within the sequence of amino acids and a reaction partner. The recognition tag may be a peptide sequence that is not naturally present in the polypeptide comprising the TGase recognition tag. In some embodiments, the TGase recognition tag comprises at least one Gln. In some embodiments, the TGase recognition tag comprises an amino acid sequence XXQX (SEQ ID NO: 1935), wherein X is any amino acid (e.g., conventional amino acid Leu, Ala, Gly, Ser, Val, Phe, Tyr, His, Arg, Asn, Glu, Asp, Cys, Gln, lie, Met, Pro, Thr, Lys, or Trp or nonconventional amino acid). In some embodiments, the acyl donor glutamine-containing tag comprises an amino acid sequence selected from the group consisting of LLQGG (SEQ ID NO:1936), LLQG (SEQ ID NO:1937), LSLSQG (SEQ ID NO:1938), gGGLLQGG (SEQ ID NO:1939), gLLQG (SEQ ID NO:1940), LLQ, gSPLAQSHGG (SEQ ID NO:1941), gLLQGGG (SEQ ID NO:1942), gLLQGG (SEQ ID NO:1943), gLLQ (SEQ ID NO:1944), LLQLLQGA (SEQ ID NO:1945), LLQGA (SEQ ID NO:1946), LLQYQGA (SEQ ID NO:1947), LLQGSG (SEQ ID NO:1948), LLQYQG (SEQ ID NO:1949), LLQLLQG (SEQ ID NO:1950), SLLQG (SEQ ID NO:1951), LLQLQ (SEQ ID NO:1952), LLQLLQ (SEQ ID NO:1953), and LLQGR (SEQ ID NO:1954). See for example, WO2012059882, the entire contents of which are incorporated herein.

The term "antibody," as used herein, means any antigen-binding molecule or molecular complex comprising at least one complementarity determining region (CDR) that specifically binds to or interacts with a particular antigen. The term "antibody" includes immunoglobulin molecules comprising four polypeptide chains, two heavy (H) chains and two light (L) chains inter-connected by disulfide bonds, as well as multimers thereof (e.g., IgM). Each heavy chain comprises a heavy chain variable region (abbreviated herein as HCVR or VH) and a heavy chain constant region. The heavy chain constant region comprises three domains, CH1, CH2, and CH3. Each light chain comprises a light chain variable region (abbreviated herein as LCVR or VL) and a light chain constant region. The light chain constant region comprises one domain (CL1). The VH and VL regions can be further subdivided into regions of hypervariability, termed complementarity determining regions (CDRs), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. In different embodiments, the FRs of the antibody (or antigen-binding portion thereof) can be identical to the human germline sequences, or can be naturally or artificially modified. An amino acid consensus sequence can be defined based on a side-by-side analysis of two or more CDRs.

The term "antibody," as used herein, also includes antigen-binding fragments of full antibody molecules. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. Antigen-binding fragments of an antibody can be derived, e.g., from full antibody molecules using any suitable standard techniques such as proteolytic digestion or recombinant genetic engineering techniques involving the manipulation and expression of DNA encoding antibody variable and optionally constant domains. Such DNA is known and/or is readily available from, e.g., commercial sources, DNA libraries (including, e.g., phage-antibody libraries), or can be synthesized. The DNA can be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g., monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain can be of any size or amino acid composition and will generally comprise at least one CDR which is adjacent to or in frame with one or more framework sequences. In antigen-binding fragments having a VH domain associated with a VL domain, the VH and VL domains can be situated relative to one another in any suitable arrangement. For example, the variable region can be dimeric and contain VH-VH, VH-VL or VL-VL dimers.

Alternatively, the antigen-binding fragment of an antibody can contain a monomeric VH or VL domain.

In certain embodiments, an antigen-binding fragment of an antibody can contain at least one variable domain covalently linked to at least one constant domain. Non-limiting, exemplary configurations of variable and constant domains that can be found within an antigen-binding fragment of an antibody of the present description include: (i) VH-CH1; (ii) VH-CH2; (iii) VH-CH3; (iv) VH-CH1-CH2; (V) VH-CH1-CH2-CH3; (vi) VH-CH2-CH3; (vii) VH-CL; (viii) VL-CH1; (ix) VL-CH2; (x) VL-CH3; (xi) VL-CH1-CH2; (xii) VL-CH1-CH2-CH3; (xiii) VL-CH2-CH3; and (xiv) VL-CL. In any configuration of variable and constant domains, including any of the exemplary configurations listed herein, the variable and constant domains can be either directly linked to one another or can be linked by a full or partial hinge or linker region. A hinge region can consist of at least 2 (e.g., 5, 10, 15, 20, 40, 60, or more) amino acids which result in a flexible or semi-flexible linkage between adjacent variable and/or constant domains in a single polypeptide molecule.

Moreover, an antigen-binding fragment of an antibody of the present description can comprise a homo-dimer or hetero-dimer (or other multimer) of any of the variable and constant domain configurations listed herein in non-covalent association with one another and/or with one or more monomeric VH or VL domain (e.g., by disulfide bond(s)).

As with full antibody molecules, antigen-binding fragments can be monospecific or multispecific (e.g., bispecific). A multispecific antigen-binding fragment of an antibody will typically comprise at least two different variable domains, wherein each variable domain is capable of specifically binding to a separate antigen or to a different epitope on the same antigen. Any multispecific antibody format, including the exemplary bispecific antibody formats disclosed herein, can be adapted for use in the context of an antigen-binding fragment of an antibody of the present description using routine techniques available in the art.

The antibodies of the present description can function through complement-dependent cytotoxicity (CDC) or antibody-dependent cell-mediated cytotoxicity (ADCC). "Complement-dependent cytotoxicity" (CDC) refers to lysis of antigen-expressing cells by an antibody of the description in the presence of complement. "Antibody-dependent cell-mediated cytotoxicity" (ADCC) refers to a cell-mediated reaction in which nonspecific cytotoxic cells that express Fc receptors (FcRs) (e.g., Natural Killer (NK) cells, neutrophils, and macrophages) recognize bound antibody on a target cell and thereby lead to lysis of the target cell. CDC and ADCC can be measured using assays that are well known and available in the art. (See, e.g., U.S. Pat. Nos. 5,500,362 and 5,821,337, and Clynes et al. (1998) *Proc. Natl. Acad. Sci.* (USA) 95:652-656). The constant region of an antibody is important in the ability of an antibody to fix complement and mediate cell-dependent cytotoxicity. Thus, the isotype of an antibody can be selected on the basis of whether it is desirable for the antibody to mediate cytotoxicity.

In certain embodiments, the antibodies of the description, e.g., anti-HER2 antibodies, or anti-HER2/HER2 bispecific antibodies, or anti-MET antibodies, or anti-MET/MET bispecific antibodies, or anti-STEAP2 antibodies, are human antibodies. The term "human antibody," as used herein, is intended to include antibodies having variable and constant regions derived from human germline immunoglobulin sequences. The human antibodies of the description can include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody," as used herein, is not intended to include antibodies in which CDR sequences derived from the germline of another mammalian species, such as a mouse, have been grafted onto human framework sequences.

The antibodies can, in some embodiments, be recombinant human antibodies. The term "recombinant human antibody," as used herein, is intended to include all human antibodies that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (See, e.g., Taylor et al. (1992) *Nucl. Acids Res.* 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

Human antibodies can exist in two forms that are associated with hinge heterogeneity. In one form, an immunoglobulin molecule comprises a stable four chain construct of approximately 150-160 kDa in which the dimers are held together by an interchain heavy chain disulfide bond. In a second form, the dimers are not linked via inter-chain disulfide bonds and a molecule of about 75-80 kDa is formed composed of a covalently coupled light and heavy chain (half-antibody). These forms have been extremely difficult to separate, even after affinity purification. The frequency of appearance of the second form in various intact IgG isotypes is due to, but not limited to, structural differences associated with the hinge region isotype of the antibody. A single amino acid substitution in the hinge region of the human IgG4 hinge can significantly reduce the appearance of the second form (Angal et al. (1993) *Molecular Immunology* 30: 105) to levels typically observed using a human IgG1 hinge. The instant description encompasses antibodies having one or more mutations in the hinge, CH2 or CH3 region which can be desirable, for example, in production, to improve the yield of the desired antibody form.

The antibodies of the description can be isolated or purified antibodies. An "isolated antibody" or "purified antibody," as used herein, means an antibody that has been identified and separated and/or recovered from at least one component of its natural environment. For example, an antibody that has been separated or removed from at least one component of an organism, or from a tissue or cell in which the antibody naturally exists or is naturally produced, is an "isolated antibody" for purposes of the present description. For example, an antibody that has been purified from at least one component of a reaction or reaction sequence, is a "purified antibody" or results from purifying the antibody. An isolated antibody also includes an antibody in situ within a recombinant cell. Isolated antibodies are antibodies that have been subjected to at least one purification or isolation step. According to certain embodiments, an isolated antibody or purified antibody can be substantially free of other cellular material and/or chemicals.

The antibodies disclosed herein can comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present description includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the VH and/or VL domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived).

Furthermore, the antibodies of the present description can contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, improved drug-to-antibody ratio (DAR) for antibody-drug conjugates, etc. Antibodies and antigen-binding fragments obtained in this general manner are encompassed within the present description.

The term "aglycosylated antibody" refers to an antibody that does not comprise a glycosylation sequence that might interfere with a transglutamination reaction, for instance an antibody that does not have saccharide group at N297 on one or more heavy chains. In particular embodiments, an antibody heavy chain has an N297 mutation. In other words, the antibody is mutated to no longer have an asparagine residue at position 297 according to the EU numbering system as disclosed by Kabat et al. In particular embodiments, an antibody heavy chain has an N297Q or an N297D mutation. Such an antibody can be prepared by site-directed mutagenesis to remove or disable a glycosylation sequence or by site-directed mutagenesis to insert a glutamine residue at site apart from any interfering glycosylation site or any other interfering structure. Such an antibody also can be isolated from natural or artificial sources. Aglycosylated antibodies also include antibodies comprising a T299 or S298P or other mutations, or combinations of mutations that result in a lack of glycosylation.

The term "deglycosylated antibody" refers to an antibody in which a saccharide group at is removed to facilitate transglutaminase-mediated conjugation. Saccharides include, but are not limited to, N-linked oligosaccharides. In some embodiments, deglycosylation is performed at residue N297. In some embodiments, removal of saccharide groups is accomplished enzymatically, included but not limited to via PNGase.

The term "epitope" refers to an antigenic determinant that interacts with a specific antigen binding site in the variable region of an antibody molecule known as a paratope. A single antigen can have more than one epitope. Thus, different antibodies can bind to different areas on an antigen and can have different biological effects. Epitopes can be either conformational or linear. A conformational epitope is produced by spatially juxtaposed amino acids from different segments of the linear polypeptide chain. A linear epitope is one produced by adjacent amino acid residues in a polypeptide chain. In certain circumstance, an epitope can include moieties of saccharides, phosphoryl groups, or sulfonyl groups on the antigen.

The terms "conjugated protein" or "conjugated antibody" as used herein refers to a protein or an antibody covalently linked to one or more chemical moieties. The chemical moiety can include an amine compound of the present disclosure. Linkers (L) and payloads (D) suitable for use with the present disclosure are described in detail herein. In particular embodiments, a conjugated antibody comprising a therapeutic moiety is an antibody-drug conjugate (ADC), also referred to as an antibody-payload conjugate, or an antibody-linker-payload conjugate.

The term "Drug-to-Antibody Ratio" or (DAR) is the average number of therapeutic moieties, e.g., drugs, conjugated to a binding agent of the present disclosure.

The term "Linker Antibody Ratio" or (LAR), also denoted as the lower case I in some embodiments, is the average number of reactive primary amine compounds conjugated to a binding agent of the present disclosure. Such binding agents, e.g., antibodies, can be conjugated with primary amine compounds comprising, e.g., a suitable azide or alkyne. The resulting binding agent, which is functionalized with an azide or an alkyne can subsequently react with a therapeutic moiety comprising the corresponding azide or alkyne via the 1,3-cycloaddition reaction.

The phrase "pharmaceutically acceptable amount" refers to an amount effective or sufficient in treating, reducing, alleviating, or modulating the effects or symptoms of at least one health problem in a subject in need thereof. For example, a pharmaceutically acceptable amount of an antibody or antibody-drug conjugate is an amount effective for modulating a biological target using the antibody or antibody-drug-conjugates provided herein. Suitable pharmaceutically acceptable amounts include, but are not limited to, from about 0.001% up to about 10%, and any amount in between, such as about 0.01%, about 0.02%, about 0.03%, about 0.04%, about 0.05%, about 0.06%, about 0.07%, about 0.08%, about 0.09%, about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, or about 10% of an antibody or antibody-drug-conjugate provided herein.

The phrase "reaction pH" refers to the pH of a reaction after all reaction components or reactants have been added.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 95%, and more preferably at least about 96%, 97%, 98% or 99% of the nucleotide bases, as measured by any well-known algorithm of sequence identity, such as FASTA, BLAST or gap, as discussed below. A nucleic acid molecule having substantial identity to a reference nucleic acid molecule can, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs gAP or BESTFIT using default gap weights, share at least 95% sequence identity, even more preferably at least 98% or 99% sequence identity. Preferably, residue positions which are not identical differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity can be adjusted upwards to correct for the conservative nature of the substitution. Means for making this adjustment are well-known to those of skill in the art. See, e.g., Pearson (1994) Methods Mol. Biol. 24: 307-331. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. In some embodiments, conservative amino acids substitution groups are: valine-leucine-isoleucine, phenylalanine-tyrosine, lysine-arginine, alanine-valine, glutamate-aspartate, and asparagine-glutamine.

Alternatively, a conservative replacement is any change having a positive value in the PAM250 log-likelihood matrix disclosed in Gonnet et al. (1992) *Science* 256: 1443-1445. A "moderately conservative" replacement is any change having a nonnegative value in the PAM250 log-likelihood matrix.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, gCG software contains programs such as gap and Bestfit which can be used with default parameters to determine sequence homology or sequence identity between closely related polypeptides, such as homologous polypeptides from different species of organisms or between a wild type protein and a mutein thereof. See, e.g., gCG Version 6.1. Polypeptide sequences also can be compared using FASTA using default or recommended parameters, a program in gCG Version 6.1. FASTA (e.g., FASTA2 and FASTA3) provides alignments and percent sequence identity of the regions of the best overlap between the query and search sequences (Pearson (2000) supra). Another particular algorithm when comparing a sequence of the description to a database containing a large number of sequences from different organisms is the computer program BLAST, especially BLASTP or TBLASTN, using default parameters. See, e.g., Altschul et al. (1990) *J. Mol. Biol.* 215:403-410 and Altschul et al. (1997) *Nucleic Acids Res.* 25:3389-402.

Protein-Drug Conjugate Compounds

According to the foregoing objective and others, the present disclosure provides protein-drug conjugate compounds, e.g., antibody-drug conjugate compounds, and precursors and intermediates thereof, pharmaceutical compositions, and methods for treating certain diseases in a subject in need of such treatment. According to the disclosure, the protein-drug conjugate compounds provided herein comprise a glutaminyl-modified binding agent conjugated with a primary amine compound linked to a therapeutic moiety, e.g., camptothecin analog moiety, as described herein.

In one aspect, the present disclosure provides compounds comprising a binding agent according to the present disclosure, (e.g., an antibody or a fragment thereof), having one or more glutamine residues conjugated to one or more camptothecin analogs, e.g., Dxd, via an optional first linker, a branching unit comprising at least one adduct, and an optional second linker. Illustrative non-limiting examples include Formula (I) and Formula (II) described herein. In specific embodiments of a protein-drug conjugate according to the disclosure, wherein the binding agent is an antibody, (e.g., a monoclonal antibody), the term "antibody drug conjugate" or ADC is optionally used.

In one aspect, the present disclosure provides a compound having a structure according to Formula (C):

$$\text{BA-Gln-NH-L1-B-(-L2-(-M-Camp)}_m)_n \quad \text{(C)},$$

wherein BA is an antibody or an antigen-binding fragment thereof; Gln is a glutamine residue; L1 is absent or a first linker; B is a branching unit comprising at least one adduct of group B' and group B", where the group B' is a first component, e.g., a first cycloaddition component; L2 is a second linker covalently attached to the branching unit B via the at least one group B", wherein B" is a second component, e.g., a second cycloaddition component, and wherein the group B' and the group B" form the at least one adduct; M is absent or a moiety having the structure

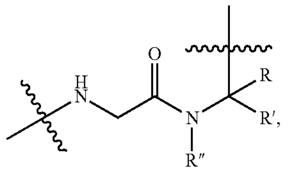

where R, R', and R" are independently at each occurrence hydrogen or a $C_1$-$C_{20}$ alkyl, or wherein R' and R" together form a ring; Camp is a camptothecin analog, and m and n are independently an integer from 1 to 30.

In one aspect, the present disclosure provides a compound having a structure according to Formula (A):

$$\text{BA-(Gln-NH-L1-B-(-L2-(-M-Dxd)}_m)_k)_n \quad \text{(A), wherein:}$$

BA is an antibody or an antigen-binding fragment thereof;

Gln is a glutamine residue;

L1 is absent or a first linker;

B is a branching unit comprising at least one adduct of group B' and group B", wherein one of the groups B' and B" is selected from $-N_3$ and

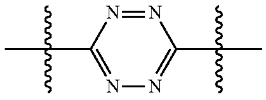;

and the other of the groups B' and B" is selected from

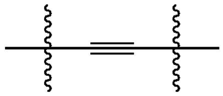,

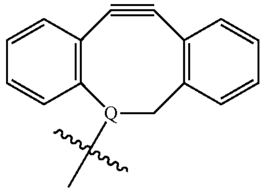; and

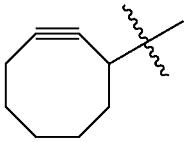, where Q is C or N;

L2 is a second linker covalently attached to the branching unit B via the at least one group B";

M is absent or a moiety having the structure

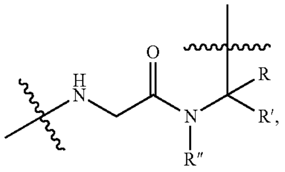

where R, R', and R" are independently at each occurrence hydrogen or a $C_1$-$C_4$ alkyl, or wherein R' and R" together form a 5-membered or a 6-membered ring;

Dxd is an anti-tumor agent having a structure according to Formula (P):

(P)

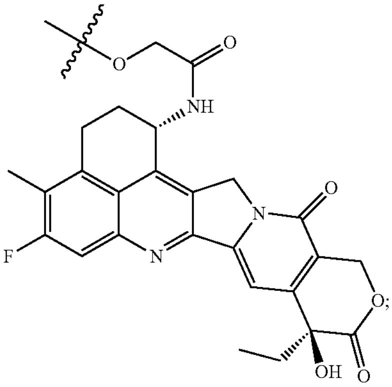;

k is an integer from 1 to 12;

m is an integer from 1 to 30, and n is an integer from 1 to 30

In one aspect, the present disclosure provides a compound having a structure according to Formula (I):

BA-(Gln-NH-L1-B-(-L2-M-Dxd)$_k$)$_n$ (I), wherein BA is an antibody or an antigen-binding fragment thereof; Gln is a glutamine residue; L1 is absent or a first linker; B is a branching unit comprising at least one adduct of group B', where the group B' is selected from —$N_3$,

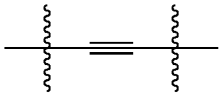,

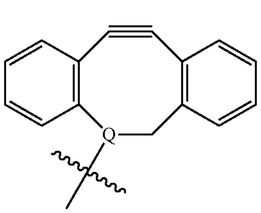;

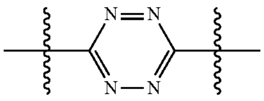; and

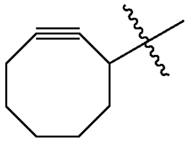, where Q is C or N; L2 is a second linker covalently attached to the branching unit B via at least one group B", wherein the group B' and the group B" form the at least one adduct; M is absent or a moiety having the structure

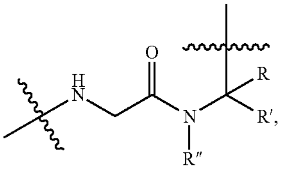

where R, R', and R" are independently at each occurrences hydrogen or a $C_1$-$C_4$ alkyl, or wherein R' and R" together form a 5-membered or a 6-membered ring; Dxd is an anti-tumor agent having a structure according to Formula (P):

(P)

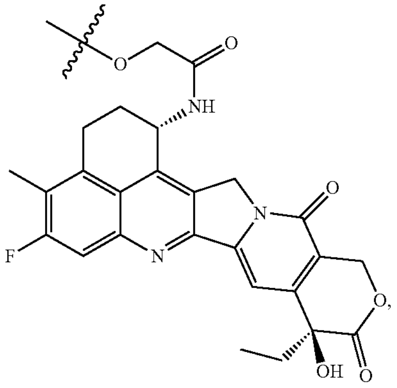

and k and n are independently an integer from 1 to 30.

Linker L1

In certain embodiments, linker L1 is absent.

In certain embodiments, linker L1 is present and is covalently attached to the amine of a glutamine residue of the binding agent BA.

In certain embodiments, linker L1 comprises an alkyl (e.g., a $C_{1-20}$ alkyl, or a $C_{1-12}$ alkyl, or a $C_{1-6}$ alkyl), —NH—, —C(O)—, —$(CH_2)_u$—NH—C(O)—, —$(CH_2)_u$—C(O)—NH—, —$(CH_2$—$CH_2$—$O)_v$—, —$(CH_2)_u$—(O—$CH_2$—$CH_2)_v$—C(O)—NH—, a peptide unit comprising from 2 to 4 amino acids, or combinations thereof, each of which may be optionally substituted with one or more of —S—, —$S(O_2)$—, —C(O)—, —$C(O_2)$—; or —$CO_2H$, wherein subscripts u and v are independently an integer from 1 to 8.

In certain embodiments, the free (unconjugated) linker L1 comprises a primary amine for attachment to the glutamine residue via a transglutamination reaction.

In one embodiment, linker L1 comprises one or more polyethylene glycol (PEG) units. In one embodiment, L1 comprises 2, or 3, or 4, or 5, or 6, or 7, or 8, or 9, or 10 PEG units.

In one embodiment, linker L1 comprises a disulfide (—S—S—) bond.

In one embodiment, linker L1 comprises a —$S(O_2)$— moiety.

In one embodiment, one or more carbons on linker L1 is substituted with —$CO_2H$.

In one embodiment, linker L1 comprises a peptide unit comprising from 2 to 4 amino acids, or a peptide unit comprising 2 amino acids, a peptide unit comprising 3 amino acids, or a peptide unit comprising 4 amino acids.

In one embodiment, linker L1 comprises a peptide unit comprising 2 amino acids selected from glycine, valine, phenylalanine, proline, glutamic acid, and citrulline, and combinations thereof. In one particular embodiment, linker L1 comprises a valine-citrulline unit.

In one embodiment, linker L1 is selected from the group consisting of:

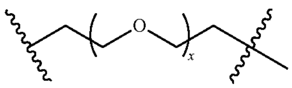

,

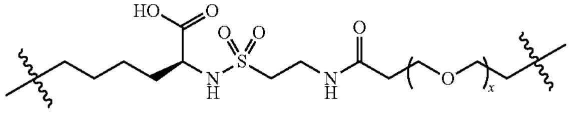

,

-continued

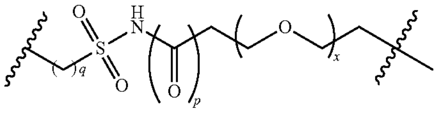

,

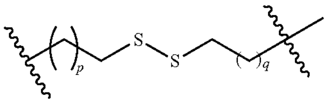

,

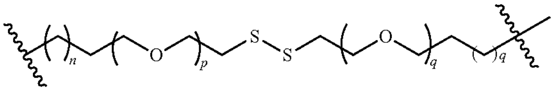

,

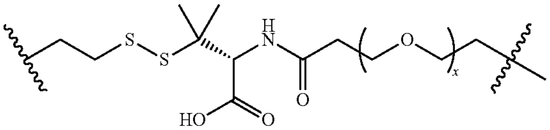

,

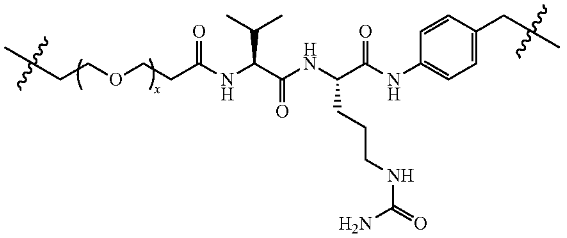

,

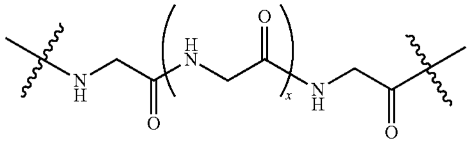

, and

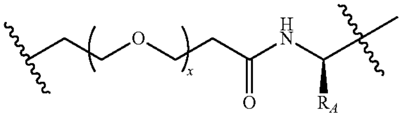

, wherein $R_A$ is a group comprising an alkyne, an azide, a tetrazine, a trans-cyclooctene, a maleimide, an amine, a ketone, an aldehyde, a carboxylic acid, an ester, a thiol, a sulfonic acid, a tosylate, a halide, a silane, a cyano group, a carbohydrate group, a biotin group, a lipid residue, and wherein subscripts x, n, p and q are independently an integer from 0 to 12, and combinations thereof.

Branching Unit B

Branching unit B comprises at least one adduct of group B'. In certain embodiments, B comprises one adduct of group B'. In certain embodiments, B comprises two adducts of group B'. In certain embodiments, B comprises three adducts of group B'.

In certain embodiments, B comprises at least four adducts of group B'. In certain embodiments, B comprises four adducts of group B'. In certain embodiments, B comprises five adducts of group B'. In certain embodiments, B comprises six adducts of group B'.

Generally, an adduct of group B' according to the present disclosure encompasses any moiety comprising the product of an addition reaction of group B', independent of the synthetic steps taken to produce the moiety.

In some embodiments, the adduct of group B' may be a product of a substituted maleimide and, e.g., a thiol, or a substituted trans-cyclooctene, e.g.:

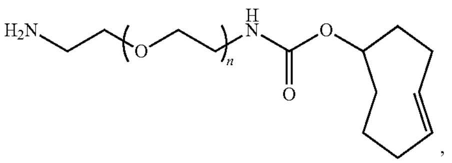

where n is an integer from 0 to 12 and, e.g., a tetrazine.

In some embodiments, the adduct of group B' may be the product of a 1,3-cycloaddition reaction between an azide and an alkyne moiety. Without wishing to be bound by theory, the azide-alkyne cycloaddition is a 1,3-dipolar cycloaddition between an azide and a terminal or internal alkyne to give a 1,2,3-triazole.

More specifically, an adduct of group B' selected from $—N_3$,

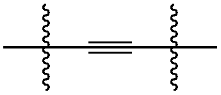
,
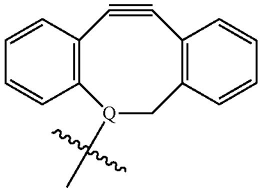
;
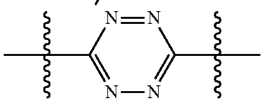
; and
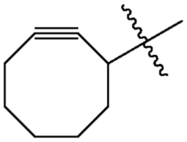
, where Q is C or N, may encompass a 1,3-cycloaddition adduct of the group B' and the group B" selected from $—N_3$,

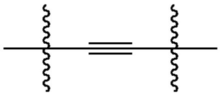
,
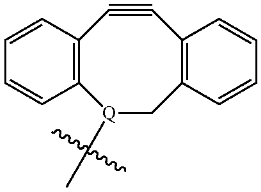
;
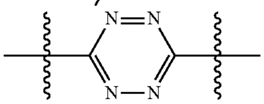
; and
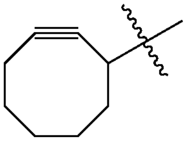
, where Q is C or N, wherein the group B" is complementary to the group B' to form a 1,3-cycloaddition adduct.

By way of a non-limiting example, group B' may be an azide ($—N_3$), and group B" may be an alkyne-containing group, e.g.,

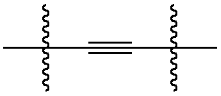
,
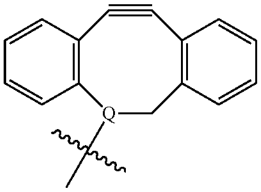
; or
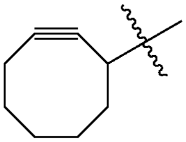
.

By way of another non-limiting example, group B' may be an alkyne-containing group, e.g.,

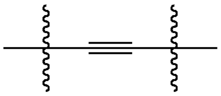
,
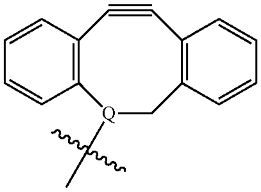
; or
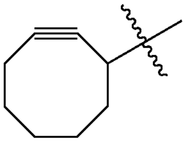

or and group B" may be an azide.

In one embodiment, the adduct of the group B' and the group B" comprises a triazole moiety. In one particular embodiment, the adduct of the group B' and the group B" has a structure selected from the group consisting of:

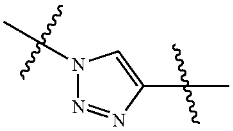
,
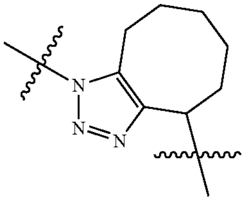
, and

-continued

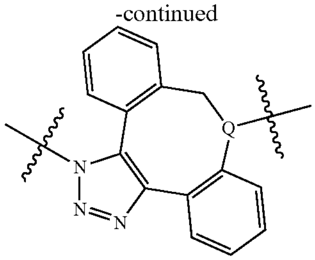

, wherein Q is C or N.

As stated above, in one embodiment, B comprises one adduct of the group B'.

In specific embodiments, L1-B is selected from the group consisting of:

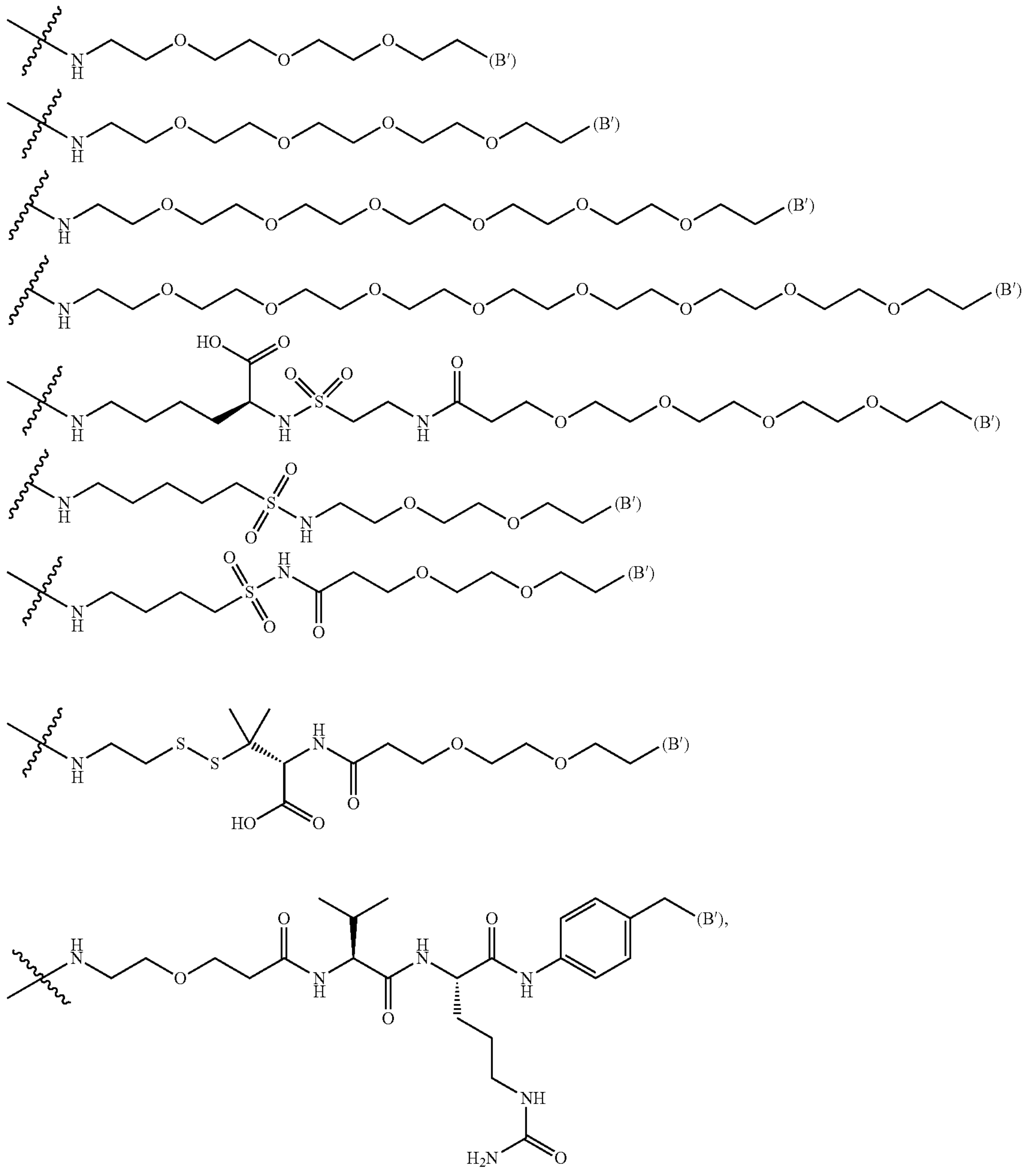

where the

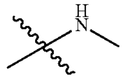 [SMILES: *NC]

is the amino point of attachment to the glutamine residue of the BA, and (B') is the adduct of the group B'.

In one embodiment, the group B' is an azide (—$N_3$), and the adduct of the group B' comprises a triazole.

According to one embodiment of the present disclosure, linkers L1-B may be azide amine linkers (AL), which comprise an amine group which directly attaches to the antibody, a PEG-containing base structure, and an azide functional group B' (n=1).

Figure 3A:
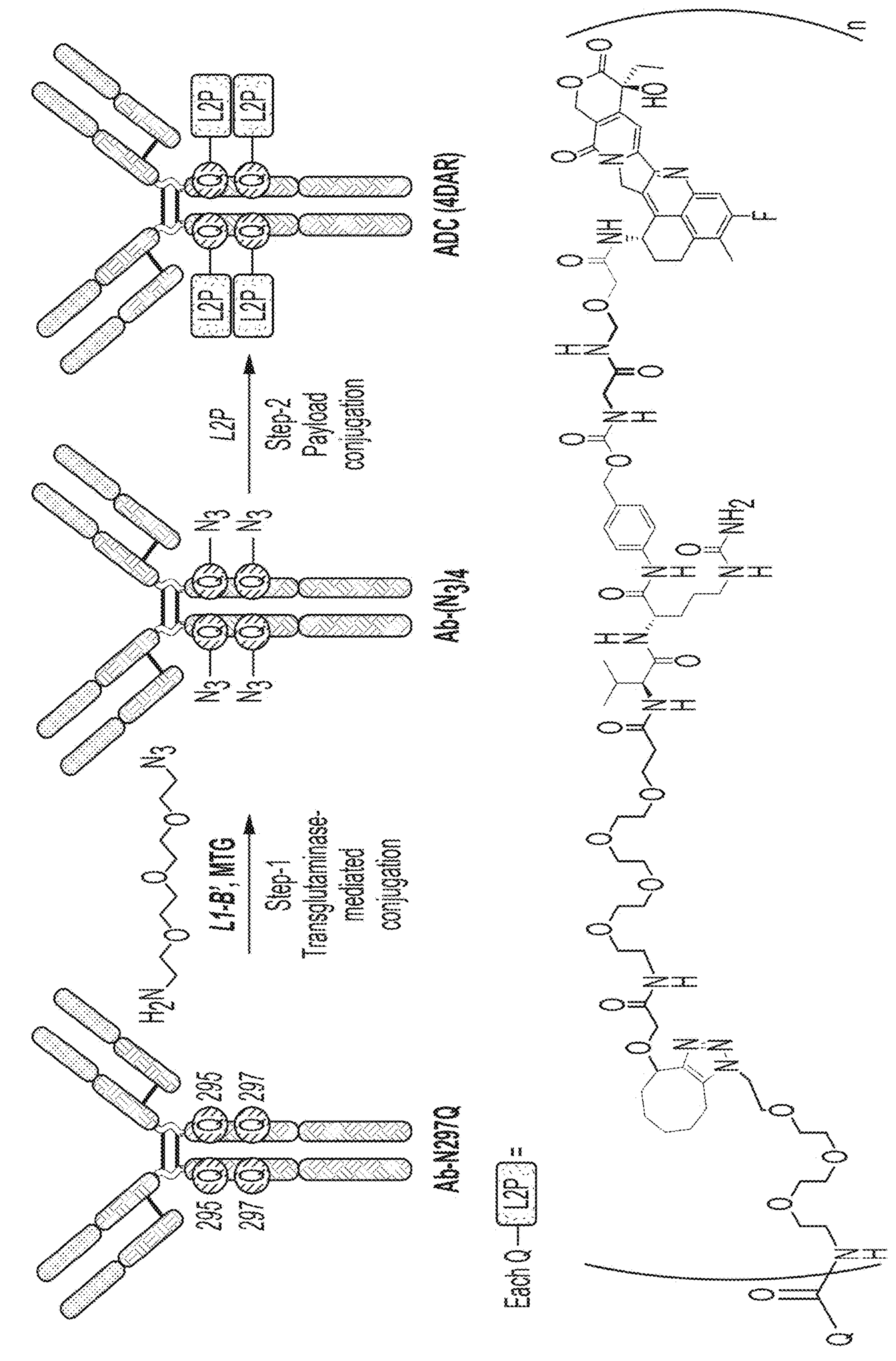
FIG. 3A is a schematic demonstrating two-step site-specific generation of one specific embodiment of a Dxd-ADC according to the disclosure. The first step is to conjugate a linear first linker 1 (L1-B') comprising one azide moiety (—$N_3$) to glutamine residues at positions 295 and 297 of an antibody via an MTG-mediated conjugation reaction, generating an antibody having 4 azide-comprising linkers attached to it (Ab-$(N_3)_4$). The second step is to attach Ab-$(N_3)_4$ to a specific Linker2-Payload (L2P) via the azide-cycloalkyne 1,3 cycloaddition reaction, generating a Dxd-ADC with a DAR of 4.
Figure 3B:
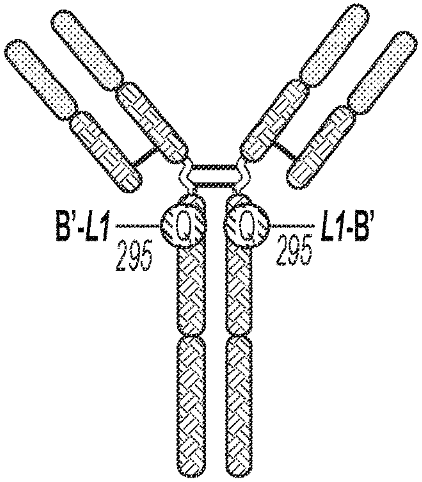
FIG. 3B depicts schematics of ADCs and exemplary amino azido linkers having a DAR of 2 or 4 suitable for use in an embodiment of the present disclosure depicted in FIG. 3A.
Figure 3B:
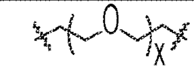
Figure 3B:
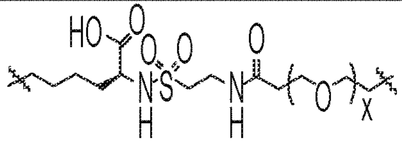
Figure 3B:
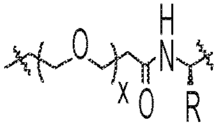
Figure 3B:
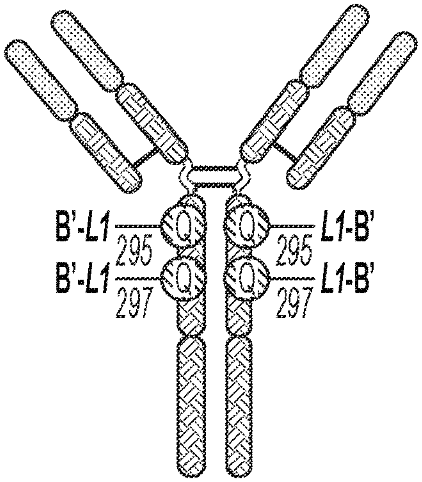
Figure 3B:
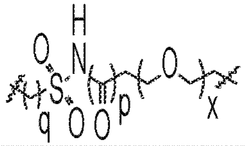
Figure 3B:
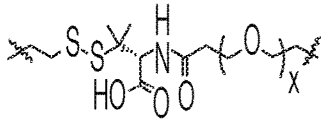
Figure 3B:
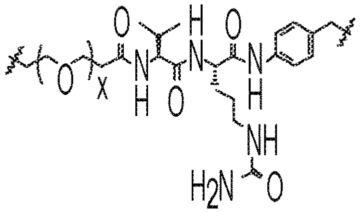

The basic component structures of non-limiting exemplary azide amine linkers are listed shown in FIG. 3B. Specific structures synthesized as examples are provided below.

In one embodiment, B comprises at least two adducts of the group B'. In specific embodiments, B comprises:

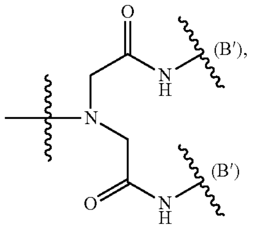

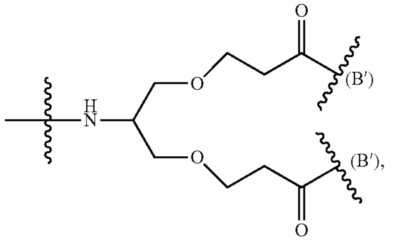

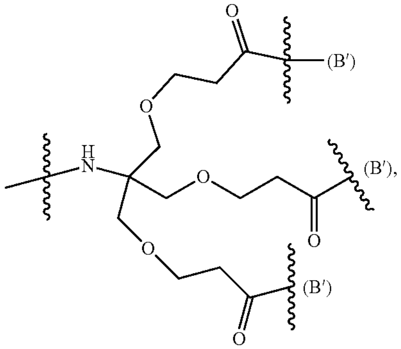

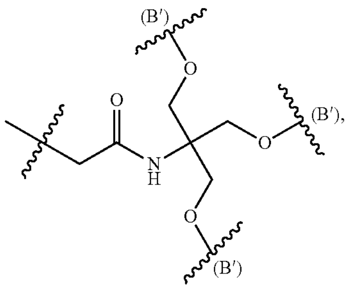

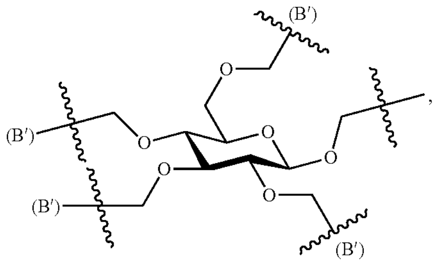

-continued

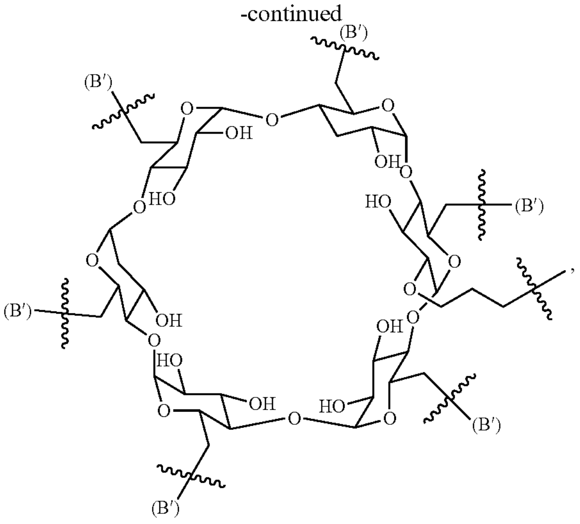

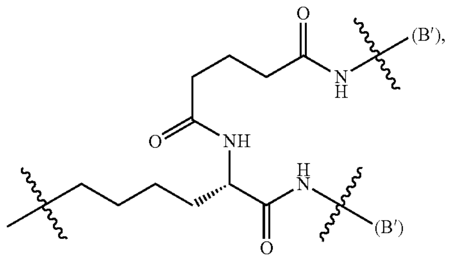

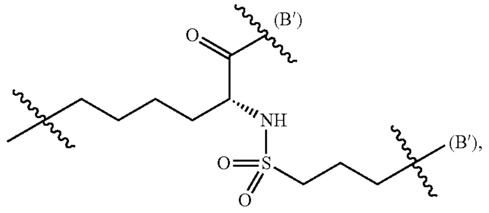

and

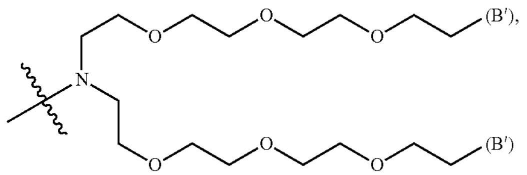

where (B') comprises points of attachment of the adduct of the group B'.

In specific embodiments, B is selected from the group consisting of:

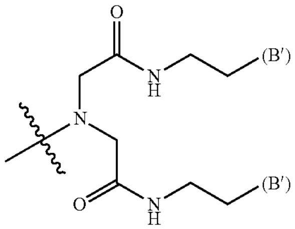
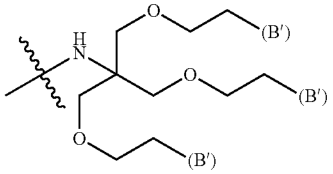
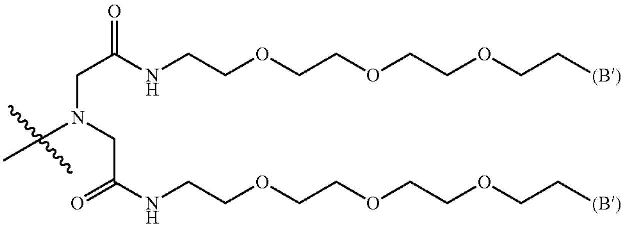
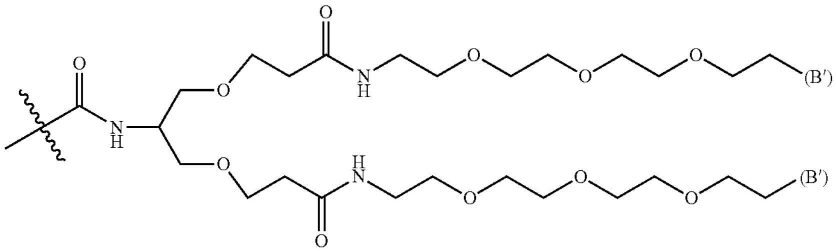
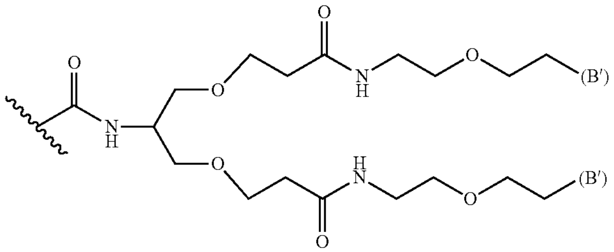
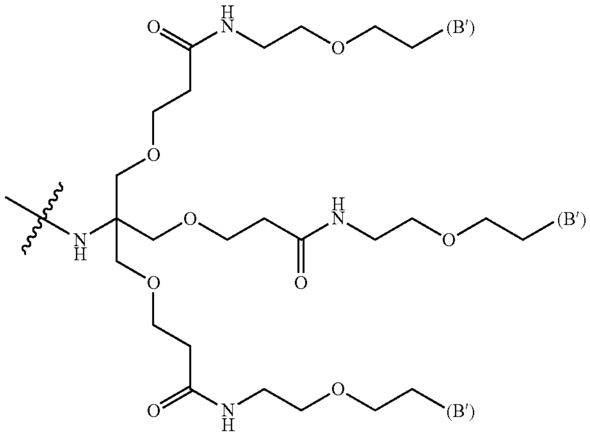

-continued
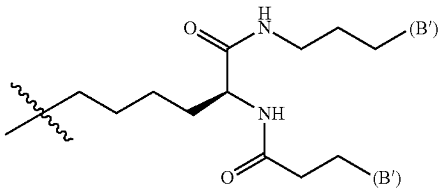
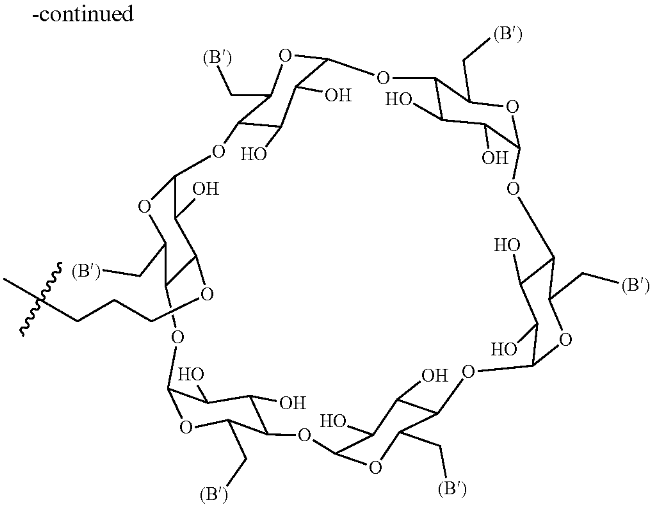
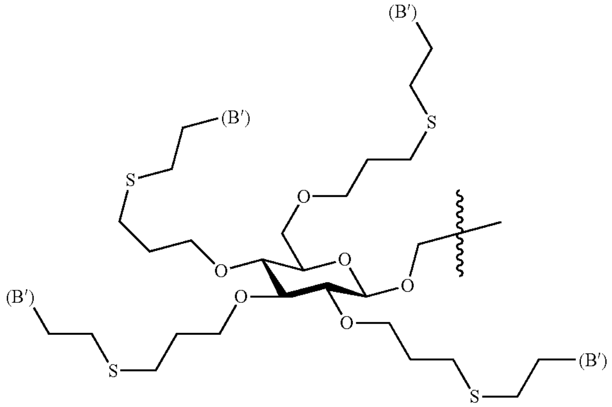
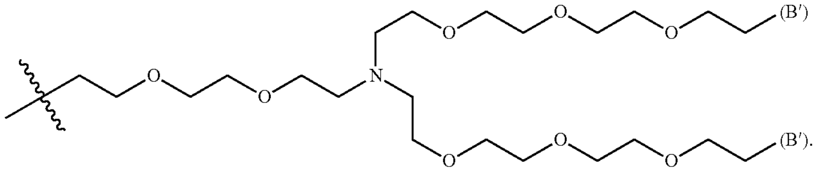
In specific embodiments, L1-B is selected from the group consisting of:
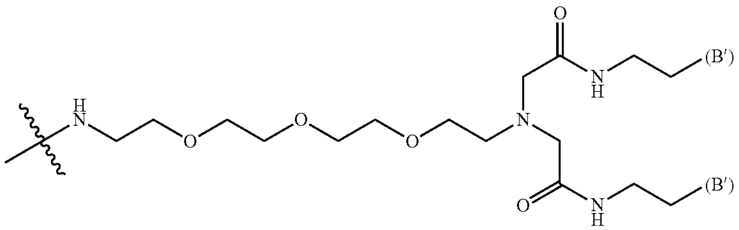
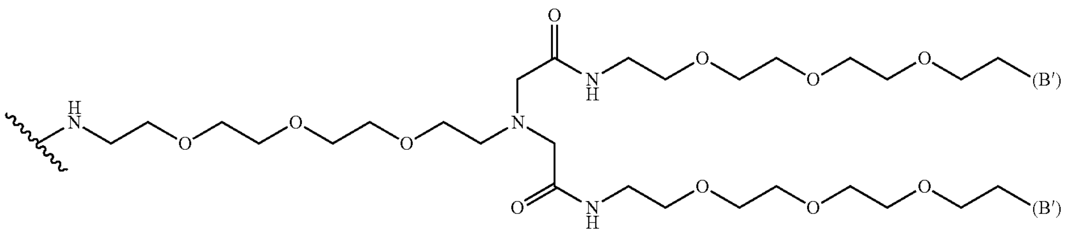

-continued
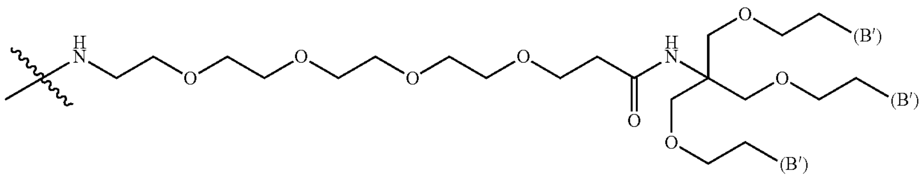
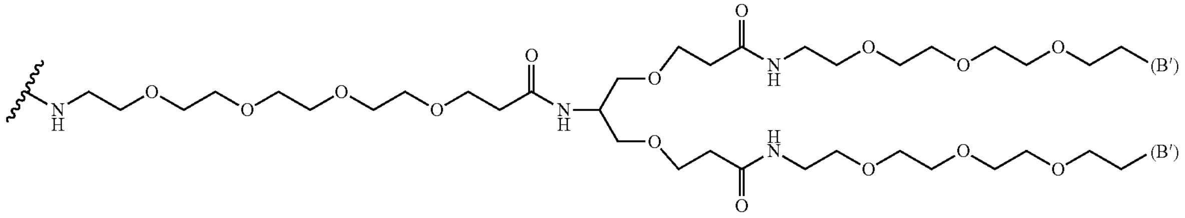
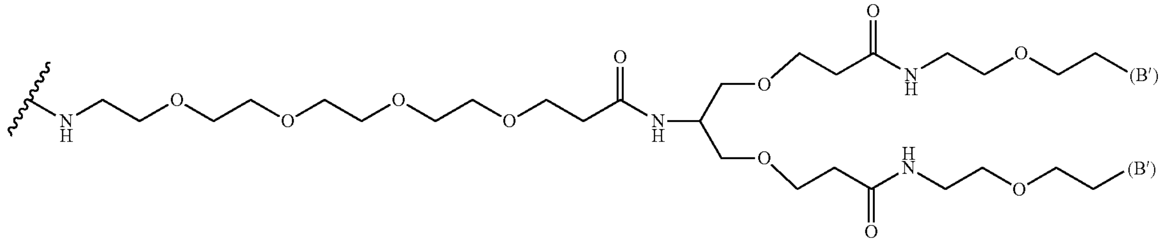
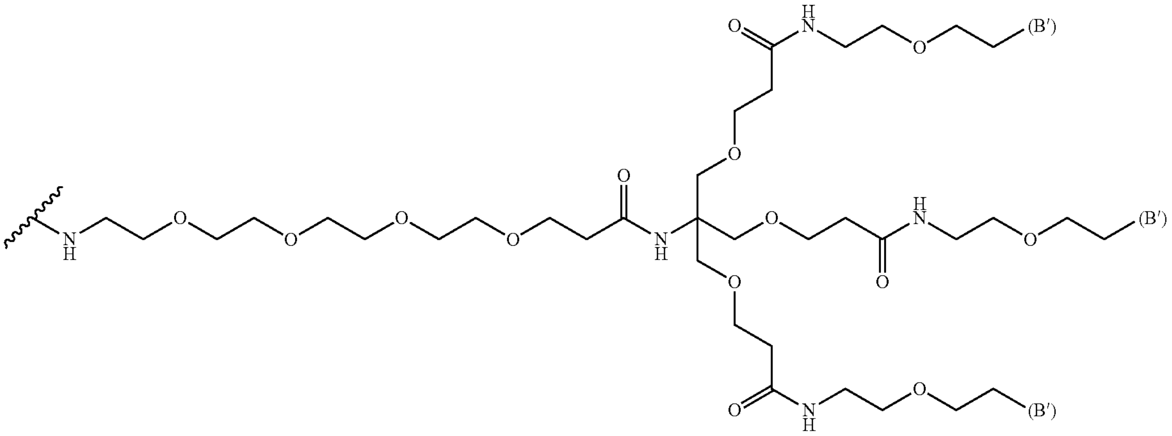
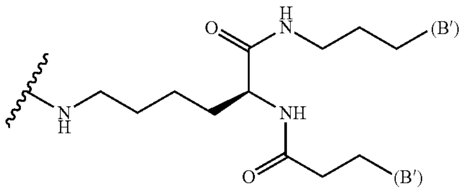
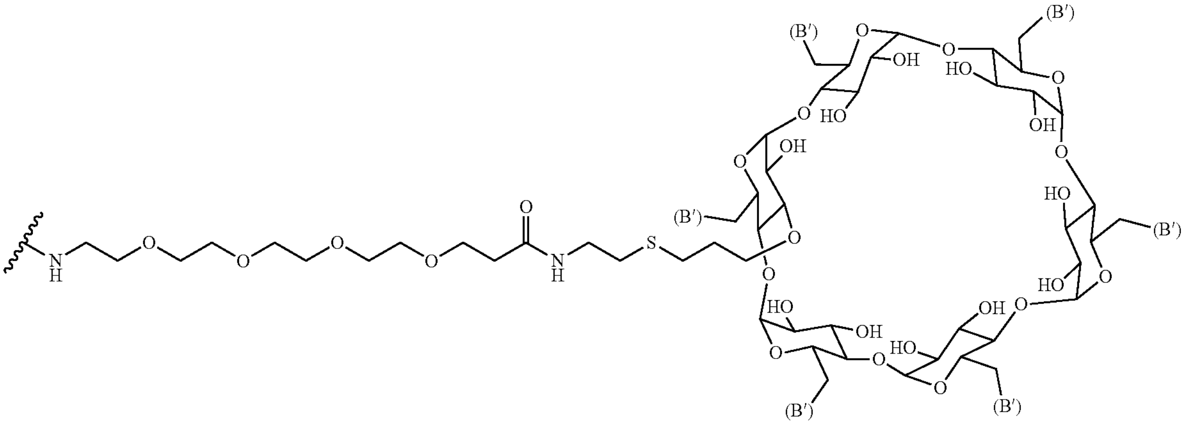

-continued

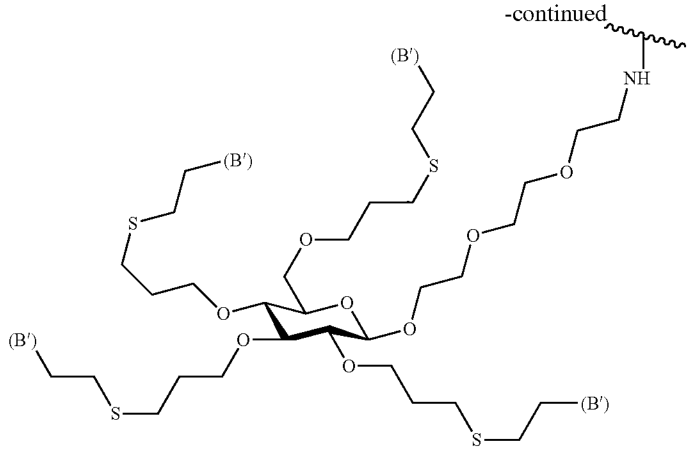

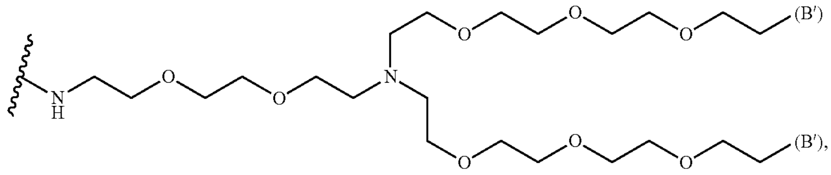

where the

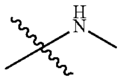

is the amino point of attachment to the glutamine residue of the BA.

According to another embodiment of the present disclosure, linkers L1-B may be branched-alkyl azide amine linkers (BL) comprising an amine group which directly attaches to the BA (e.g., an antibody), a branched-alkyl PEG containing base structure, and 2 to 6 azide functional groups B' (n=2-6).

Figure 4A:
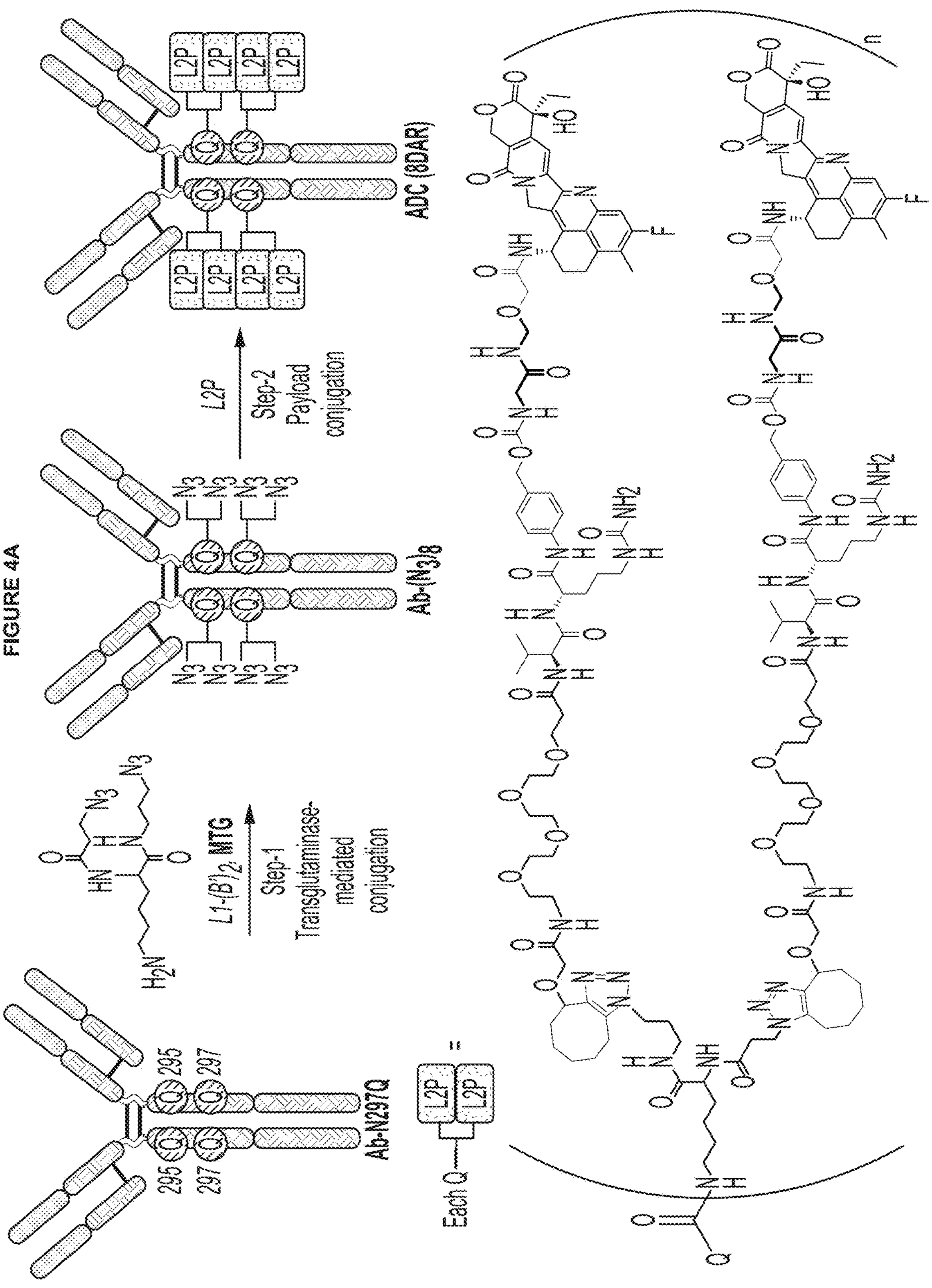
FIG. 4A is a schematic demonstrating two-step site-specific generation of one specific embodiment of a Dxd-ADC according to the disclosure. The first step is to conjugate a branched first linker 1 (L1-B') comprising two azide moieties (—$N_3$) to glutamine residues at positions 295 and 297 of an antibody via an MTG-mediated conjugation reaction, generating an antibody having 8 azide-comprising linkers attached to it (Ab-$(N_3)_8$). The second step is to attach Ab-$(N_3)_8$ to a specific Linker2-Payload (L2P) via the azide-cycloalkyne 1,3 cycloaddition reaction, generating a Dxd-ADC with a DAR of 8.
Figure 4B:
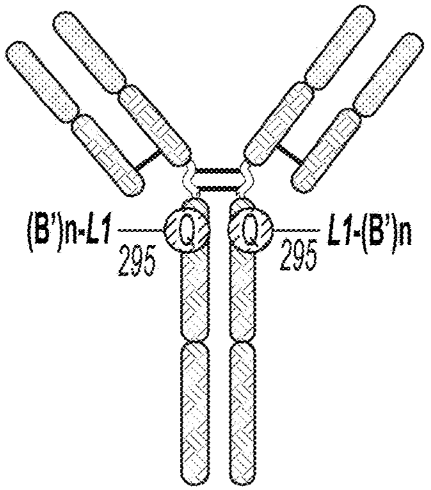
FIG. 4B depicts schematics of ADCs and exemplary branched alkyl azide amine linkers suitable for use in an embodiment of the present disclosure depicted in FIG. 4A.
Figure 4B:
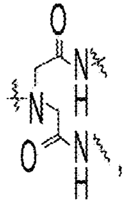
Figure 4B:
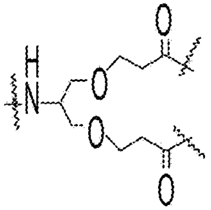
Figure 4B:
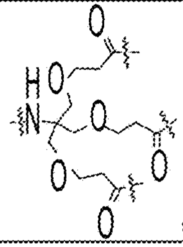
Figure 4B:
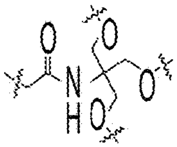
Figure 4B:
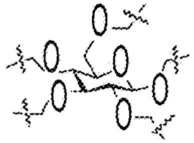
Figure 4B:
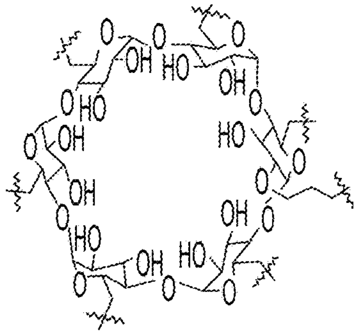
Figure 4C:
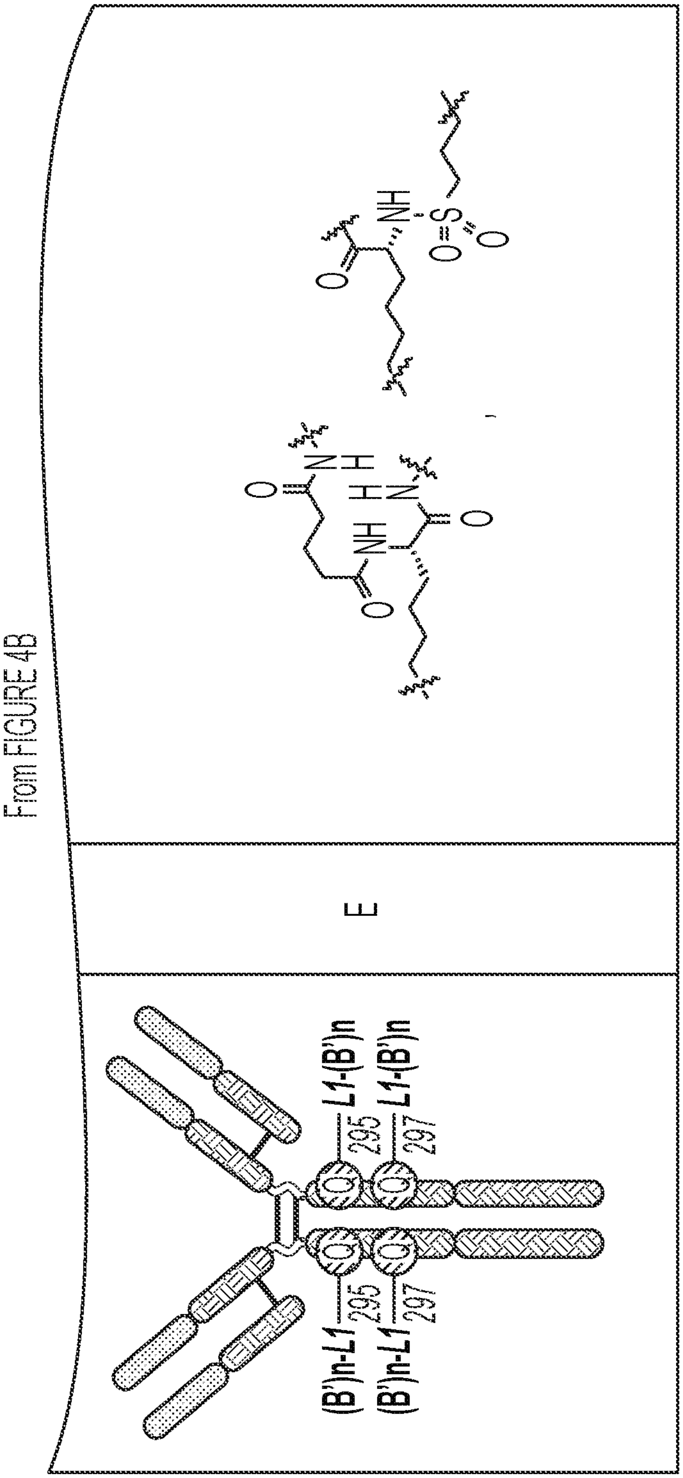

The basic component structures of exemplary non-limiting branched-alkyl azide amine linkers are listed in FIG. 4B. Specific structures synthesized as examples are provided below.

Linker L2

In certain embodiments of the present disclosure, L2 has a structure according to Formula (L2):

B"-SP1-B2-(-SP2-AA-SP3)$_p$ (L2), wherein:

B" is a group capable of covalently attaching to the group B';

SP1 is absent or a first spacer unit;

B2 is absent or a branching unit;

SP2 is absent or a second spacer unit;

AA is absent or a peptide unit comprising from 2 to 4 amino acids;

SP3 is absent or a third spacer unit, and p is an integer from 1 to 12.

In certain embodiments of the present disclosure, L2 has a structure according to Formula (L2'):

$H_2$N-SP1-B2-(-SP2-AA-SP3)$_p$ (L2')

wherein:

SP1 is absent or a first spacer unit;

B2 is absent or a branching unit;

SP2 is absent or a second spacer unit;

AA is absent or a peptide unit comprising from 2 to 4 amino acids;

SP3 is absent or a third spacer unit, and p is an integer from 1 to 12.

In certain embodiments of the present disclosure, L2 has a structure according to Formula (L2"):

Maleimide-N-SP1-B2-(-SP2-AA-SP3)$_p$ (L2"), wherein:

SP1 is absent or a first spacer unit;

B2 is absent or a branching unit;

SP2 is absent or a second spacer unit;

AA is absent or a peptide unit comprising from 2 to 4 amino acids;

SP3 is absent or a third spacer unit, and p is an integer from 1 to 12.

In some embodiments, the linker L2 comprises a group B" capable of covalently attaching to the group B' as described above.

In certain embodiments, the group B" is selected from —$N_3$,

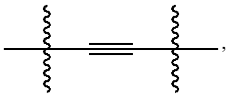

,

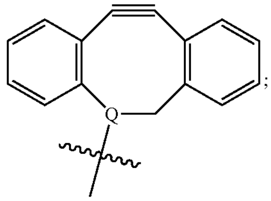

;

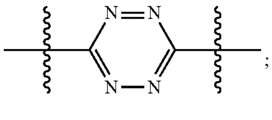

; and

-continued

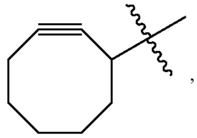

, where Q is C or N.

By way of a non-limiting example, the group B" may be an alkyne-containing group, e.g.,

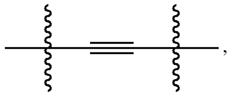

,

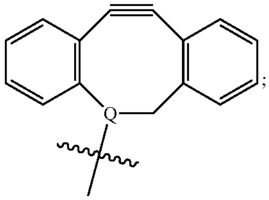

; or

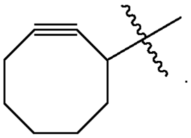

.

By way of another non-limiting example, group B" may be an azide.

In one embodiment, the adduct of the group B' and the group B" comprises a triazole moiety. In one particular embodiment, the adduct of the group B' and the group B" has a structure selected from the group consisting of:

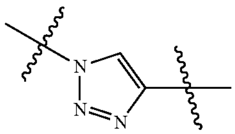

,

-continued

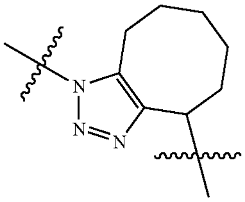

, and

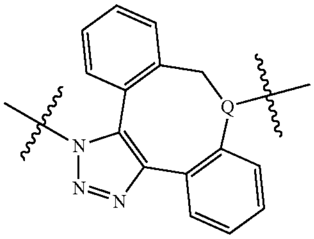

, wherein Q is C or N, or a regioisomer thereof.

In one embodiment, the first spacer SP1 is absent.

In another embodiment, SP1 is selected from the group consisting of

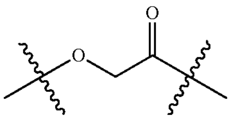

and

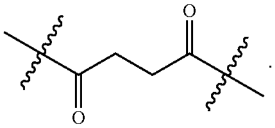

.

In one embodiment, the branching unit B2 is absent.

In one embodiment, the branching unit B2 according to the disclosure has the structure of one of B1-B5 depicted below.

| Branching Unit B2 | B1 | B2 |
| --- | --- | --- |
| Structure | 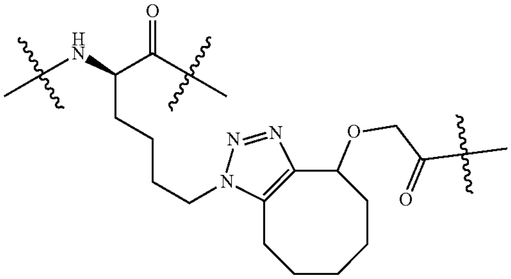 [SMILES: *N[C@H](CCCCn1nnc2c1CCCCCC2OCC(*)=O)C(*)=O] | 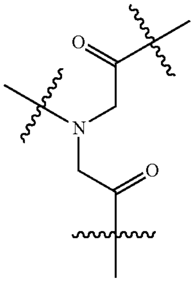 [SMILES: *C(=O)CN(*)CC(*)=O] |

-continued

| Branching Unit B2 | B3 | B4 |
|---|---|---|
| Structure | 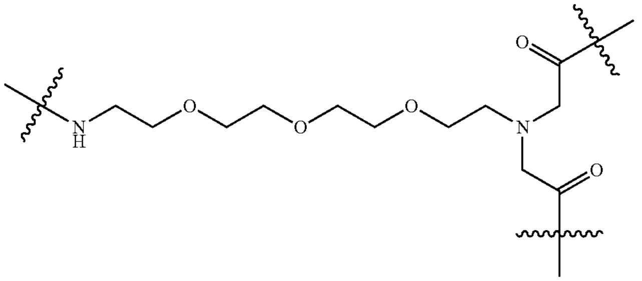 [SMILES: *NCCOCCOCCOCCN(CC(*)=O)CC(*)=O] | 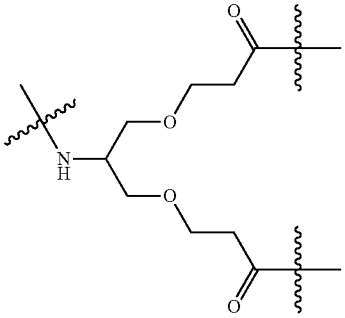 [SMILES: *NC(COCCC(*)=O)COCCC(*)=O] |

| Branching Unit B2 | B5 |
|---|---|
| Structure | 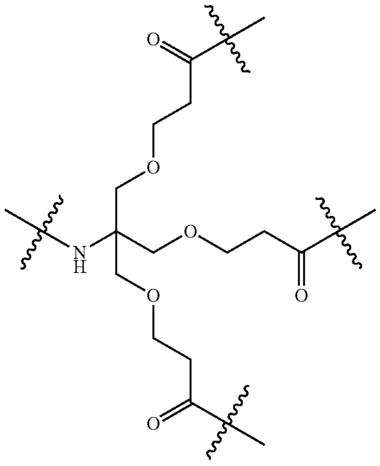 [SMILES: *NC(COCCC(*)=O)(COCCC(*)=O)COCCC(*)=O] |

In one embodiment, the second spacer SP2 is absent.

In another embodiment, SP2 is selected from the group consisting of an alkyl (e.g., a $C_{1-20}$alkyl, or a $C_{1-12}$ alkyl, or a $C_{1-10}$ alkyl, or a $C_{1-8}$ alkyl, or a $C_{1-6}$ alkyl), $—(CH_2—CH_2—O)_v—$, —NH—, —C(O)—, —NH—C(O)—, $—NH—(CH_2)_u—$, $—NH—(CH_2)_u—C(O)—$, $—NH—(CH_2—CH_2—O)_v—$, $—NH—(CH_2—CH_2—O)_v—C(O)—$, $—NH—(CH_2—CH_2—O)_v—(CH_2)_u—$, $—NH—(CH_2—CH_2—O)_v—(CH_2)_u—C(O)—$, $—(CH_2)_u—NH—C(O)—$, $—NH—(CH_2)_u—NH—C(O)—$, $—NH—(CH_2)_u—C(O)—NH—$, or combinations thereof; wherein subscripts u and v are independently an integer from 1 to 8.

In certain embodiments, AA is a peptide unit comprising from 2 to 4 amino acids selected from glycine, valine, phenylalanine, proline, glutamic acid, lysine, phenylalanine, and citrulline, and combinations thereof.

In one embodiment, AA is a peptide unit comprising 2 amino acids. In one embodiment, AA is a peptide unit comprising 3 amino acids. In one embodiment, AA is a peptide unit comprising 4 amino acids.

In one particular embodiment, AA is valine-citrulline, valine-alanine, or phenylalanine-lysine.

In another particular embodiment, AA is selected from the group consisting of glycine-glycine-glycine (GGG), glycine-glycine-glycine-glycine (GGGG (SEQ ID NO: 2113)), glycine-glycine-phenylalanine (GGF), and glycine-glycine-phenylalanine-glycine (GGFG (SEQ ID NO: 2114)) and glutamic acid-valine-citrulline (EVC).

In one embodiment, the third spacer SP3 is absent.

In another embodiment, SP3 is selected from the group consisting of

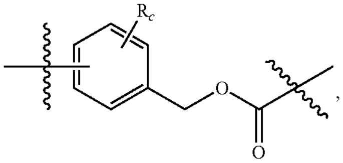,

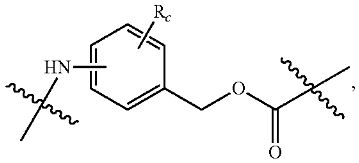,

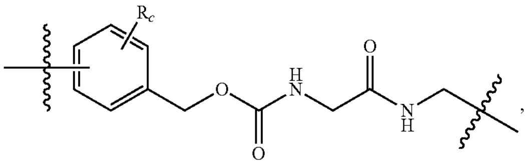,

-continued

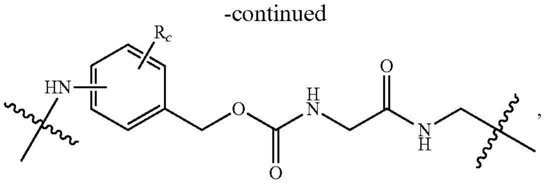

and combinations thereof, wherein R, is independently at each occurrence absent or a group selected from

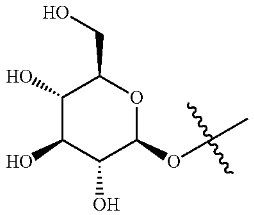

and

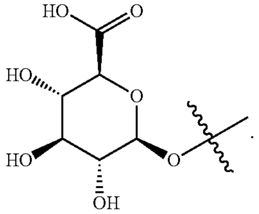

In one embodiment, the spacer SP3 is covalently attached to the camptothecin analog, e.g., Dxd or M-Dxd.

In one embodiment, the linker L2 comprises from about 1 to about 12, or from about 1 to about 10, or from about 1 to about 8, or from about 1 to about 6, or from about 1 to about 4, or from about 1 to about 2 (SP2-AA-SP3) moieties, and the linker-payload L2-Dxd comprises from about 1 to about 12, or from about 1 to about 10, or from about 1 to about 8, or from about 1 to about 6, or from about 1 to about 4, or from about 1 to about 2 Dxd payload molecules.

Moiety M

In certain embodiments, moiety M is absent.

In certain embodiments, M is present and has a structure

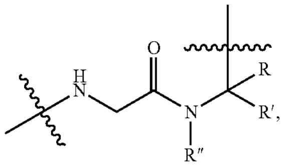

where R, R', and R" are independently at each occurrence hydrogen or alkyl, or wherein R' and R" together form a ring, e.g., a 3-membered to an 8-membered ring.

In certain embodiments, M is present and has a structure

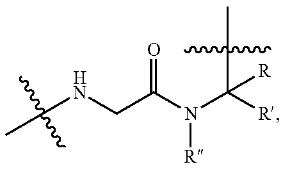

where R, R', and R" are independently at each occurrence hydrogen or a $C_1$-$C_4$ alkyl, or wherein R' and R" together form a 5-membered or a 6-membered ring.

In one embodiment, R is a hydrogen.

In one embodiment, R' is a hydrogen. In one embodiment, R' is a $C_1$-$C_4$ alkyl.

In one embodiment, R" is a hydrogen. In one embodiment, R" is a $C_1$-$C_4$ alkyl.

In one embodiment, R' and R" together form a 5-membered ring. In one embodiment, R' and R" together are $-(CH_2)_3-$.

In one embodiment, R' and R" together form a 6-membered ring. In one embodiment, R' and R" together are $-(CH_2)_4-$.

In one embodiment, R, R', and R" are hydrogens at each occurrence, i.e. M is

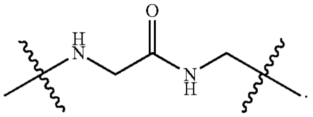 [SMILES: *CNC(=O)CN*]

In another embodiment, R is hydrogen and R' and R" together form a 5-membered ring, e.g., R' and R" together are $-(CH_2)_3-$ and M is

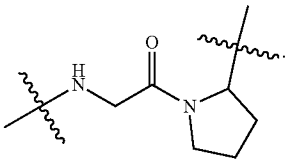 [SMILES: *NCC(=O)N1CCCC1*]

Payloads

In certain embodiments, the payloads of the present disclosure are camptothecin analogs and/or derivatives.

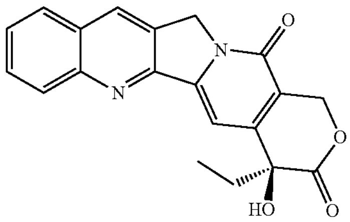 [SMILES: CC[C@@]1(O)C(=O)OCc2c1cc1n(c2=O)Cc2cc3ccccc3nc2-1]

Camptothecin

Camptothecin (CPT), shown above, is a topoisomerase poison. It was discovered in 1966 by M. E. Wall and M. C. Wani in systematic screening of natural products for anticancer drugs. It was isolated from the bark and stem of *Camptotheca acuminata* (*Camptotheca*, Happy tree), a tree native to China used as a cancer treatment in Traditional Chinese Medicine. Camptothecin showed remarkable anticancer activity in preliminary clinical trials. However, it has low solubility, so synthetic and medicinal chemists have developed numerous syntheses of camptothecin and various derivatives to increase the benefits of the chemical, with good results. Four camptothecin analogs have been approved and are used in cancer chemotherapy today: topotecan, irinotecan, belotecan, and deruxtecan (Dxd).

Trastuzumab deruxtecan (T-Dxd) is an antibody-drug conjugate that includes a human epidermal growth factor receptor 2 (HER2)-directed antibody trastuzumab and a topoisomerase I inhibitor conjugate deruxtecan (Dxd, a derivative of exatecan). It was approved for use in the United States in December 2019. Exatecan, shown below, is a camptothecin analog.

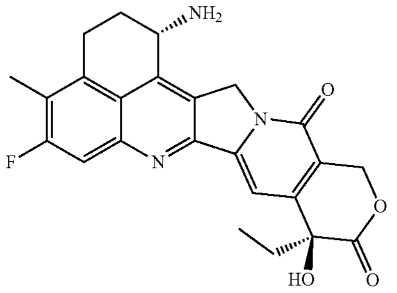

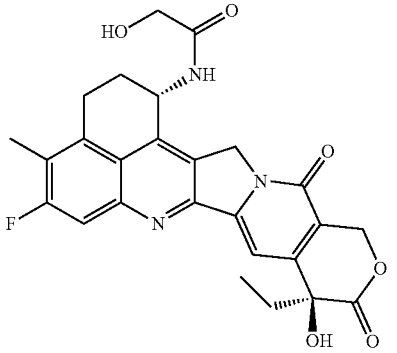

Exatecan, Left, and Deruxtecan (Dxd), Right

In one embodiment, the payload of the present disclosure is deruxtecan (Dxd).

In certain embodiments, the payload of the present disclosure is a compound having the structure P-I:

(P-I)

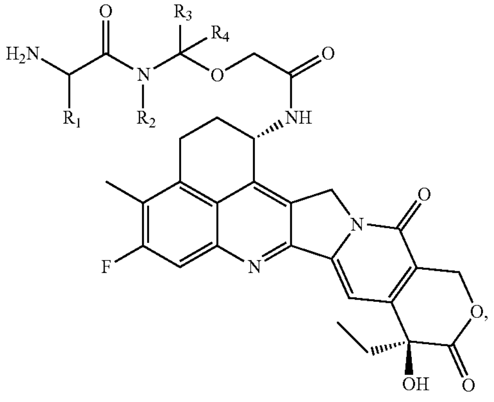

wherein $R_1$, $R_2$, and $R_3$, and $R_4$ are independently a hydrogen or an alkyl, e.g., a $C_1$-$C_{12}$ alkyl, or a $C_1$-$C_8$ alkyl, or a $C_1$-$C_6$ alkyl, or a $C_1$-$C_4$ alkyl, or wherein $R_2$ and $R_3$ together form a 5-membered or a 6-membered ring, or a pharmaceutically acceptable salt thereof.

In one embodiment, $R_1$ is a hydrogen.

In one embodiment, $R_2$ is a hydrogen. In one embodiment, $R_2$ is a $C_1$-$C_4$ alkyl.

In one embodiment, $R_3$ is a hydrogen. In one embodiment, $R_3$ is a $C_1$-$C_4$ alkyl.

In one embodiment, $R_4$ is a hydrogen. In one embodiment, $R_4$ is a $C_1$-$C_4$ alkyl.

In one embodiment, $R_1$, $R_2$, and $R_3$, and $R_4$ are a hydrogen in each occurrence. In one embodiment, the compound of the present disclosure is

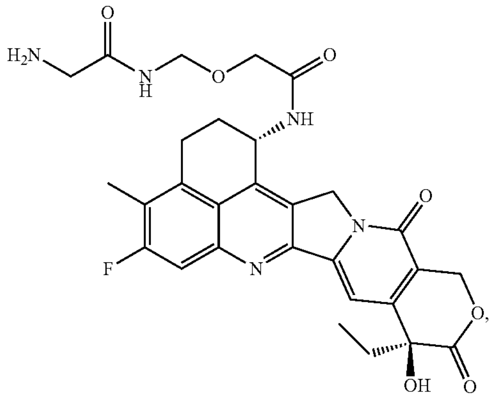 [SMILES: CC[C@@]1(O)C(=O)OCc2c1cc1n(c2=O)Cc2c-1nc1cc(F)c(C)c3c1c2[C@@H](NC(=O)COCNC(=O)CN)CC3]

or a pharmaceutically acceptable salt thereof.

In one embodiment, $R_2$ and $R_3$ together form a 5-membered ring. In one embodiment, $R_2$ and $R_3$ together are $-(CH_2)_3-$.

In one embodiment, $R_2$ and $R_3$ together form a 6-membered ring. In one embodiment, $R_2$ and $R_3$ together are $-(CH_2)_4-$.

In one embodiment, $R_1$ is a hydrogen, and $R_2$ and $R_3$ together form a 5-membered ring.

In one embodiment, the compound of the present disclosure has a structure according to Formula (P-II):

(P-II)

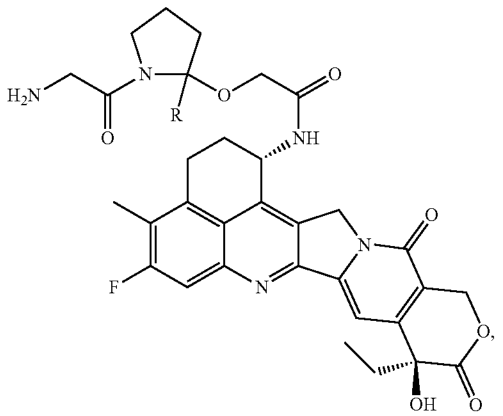

wherein R is a hydrogen or an alkyl, e.g., a $C_1$-$C_{12}$ alkyl, or a $C_1$-$C_8$ alkyl, or a $C_1$-$C_6$ alkyl, or a $C_1$-$C_4$ alkyl, or a pharmaceutically acceptable salt thereof.

It should be understood by one of skill in the art that the compound P-II depicted above is also meant to include all isomeric (e.g., enantiomeric, diastereomeric, and geometric (or conformational)) forms of the structure. For example, the R and S configurations for each asymmetric center, are within the scope of the present disclosure. By way of an example, the two isomers depicted below are within the scope of the present disclosure:

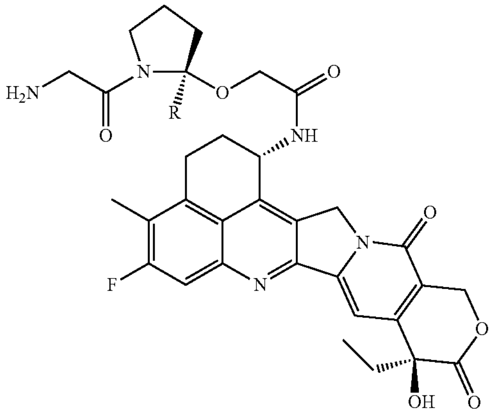

and

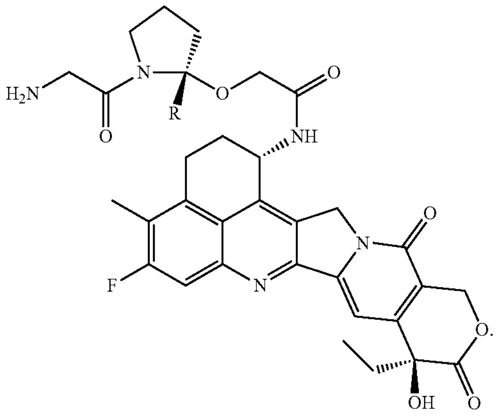

In one embodiment, the compound of the present disclosure is

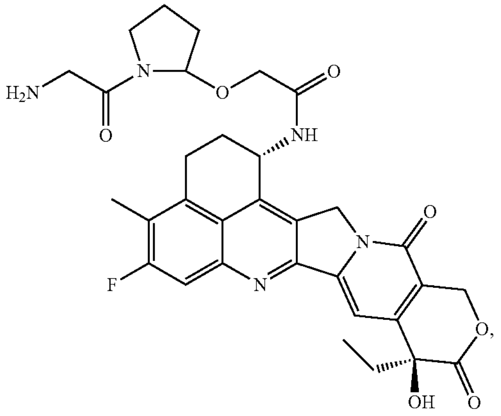

or a pharmaceutically acceptable salt thereof.

In one embodiment, the payload according to the disclosure is conjugated to form a protein-drug conjugate (e.g., an antibody-drug conjugate). In one embodiment, the payload is covalently attached to a moiety M. In one embodiment, the payload is M-Dxd. In one embodiment, M-Dxd has a structure selected from the group consisting of

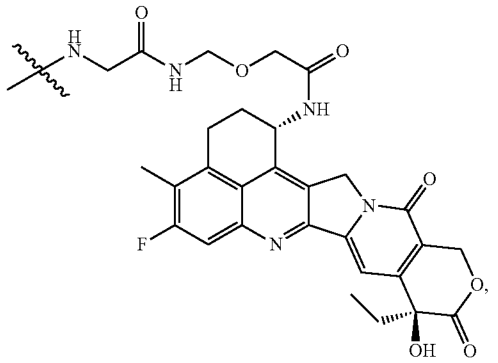

and

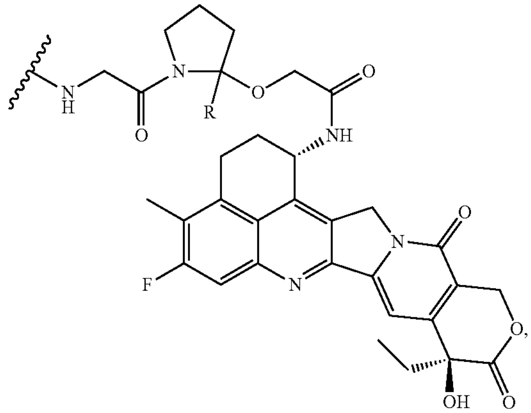

wherein R is a hydrogen or a $C_1$-$C_4$ alkyl, and where ∿∿ represents the point of attachment to L2.

The present disclosure also relates to a pharmaceutical composition comprising a therapeutically effective amount of the compound as described above or a pharmaceutically acceptable salt thereof and one or more pharmaceutically acceptable carriers, diluents, or excipients.

In one embodiment, the compound according to the disclosure has the following structure:

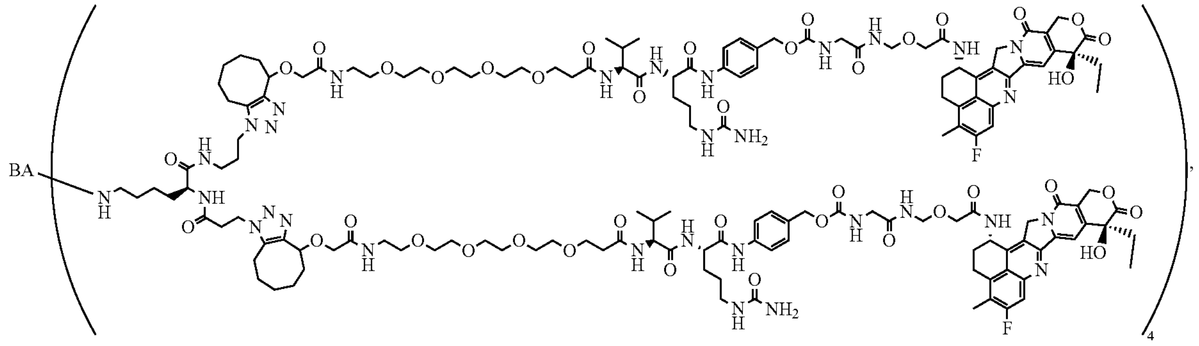

wherein BA is a binding agent (e.g., an antibody or an antigen-binding fragment thereof).

In one embodiment, the compound according to the disclosure has the following structure:

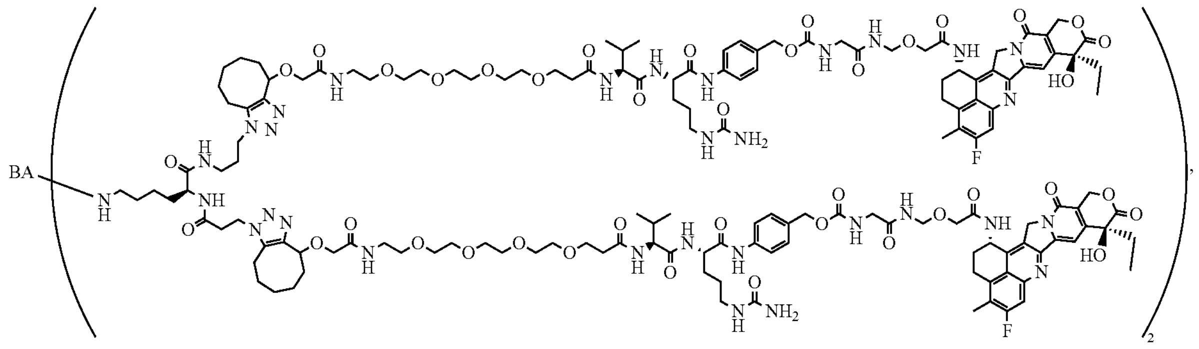

wherein BA is a binding agent (e.g., an antibody or an antigen-binding fragment thereof).

In one embodiment, the compound according to the disclosure has the following structure:

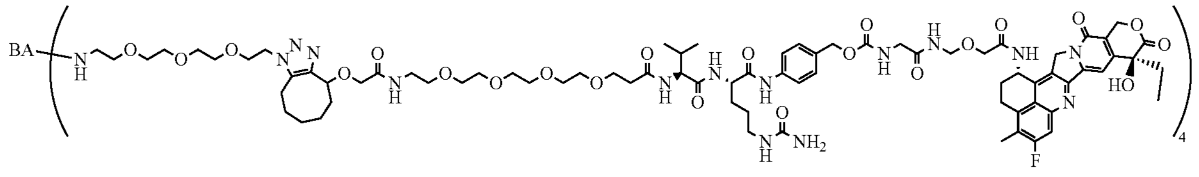

wherein BA is a binding agent (e.g., an antibody or an antigen-binding fragment thereof).

In one embodiment, the compound according to the disclosure has the following structure:

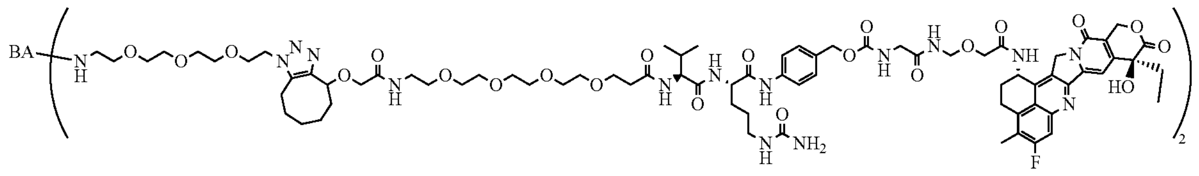

wherein BA is a binding agent (e.g., an antibody or an antigen-binding fragment thereof).

The present disclosure also relates to a pharmaceutical composition comprising a therapeutically effective amount of the compound as described above or a pharmaceutically acceptable salt thereof and one or more pharmaceutically acceptable carriers, diluents, or excipients.

Linker-Payloads (L2-P)

In another aspect, the present disclosure provides a compound according to Formula (L2-P):

B"-SP1-B2-(-SP2-AA-SP3-M-Dxd)*p* (L2-P), wherein:

B" is selected from the group consisting of —$N_3$,

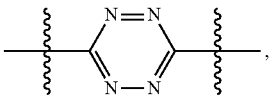

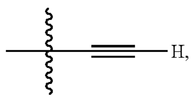

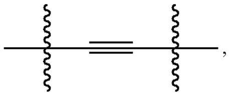

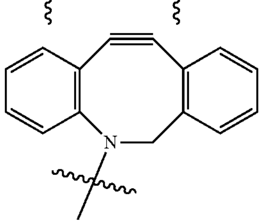

and

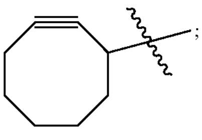

SP1 is absent or a first spacer unit selected from the group consisting of

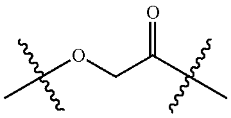

and

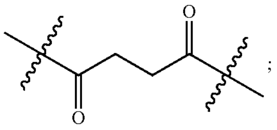

B2 is absent or a branching unit;

SP2 is absent or a second spacer unit selected from the group consisting of a $C_{1-6}$ alkyl, —$(CH_2—CH_2—O)_v$—, —NH—, —C(O)—, —NH—C(O)—, —NH—$(CH_2)_u$—, —NH—$(CH_2)_u$—C(O)—, —NH—$(CH_2—CH_2—O)_v$—, —NH—$(CH_2—CH_2—O)_v$—C(O)—, —NH—$(CH_2—CH_2—O)_v$—$(CH_2)_u$—, —NH—$(CH_2—CH_2—O)_v$—$(CH_2)_u$—C(O)—, —$(CH_2)_u$—NH—C(O)—, —NH—$(CH_2)_u$—NH—C(O)—, —NH—$(CH_2)_u$—C(O)—NH—, or combinations thereof; wherein subscripts u and v are independently an integer from 1 to 8;

AA is absent or a peptide unit comprising from 2 to 4 amino acids;

SP3 is absent or a third spacer unit selected from the group consisting of,

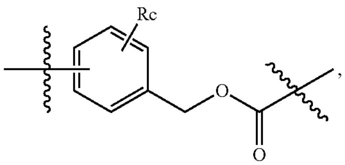

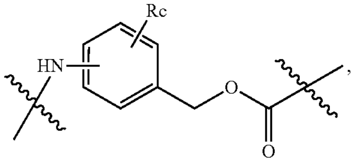

-continued

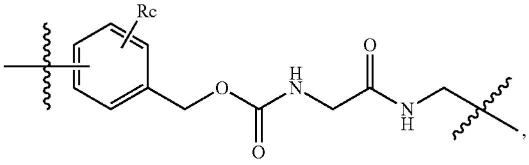

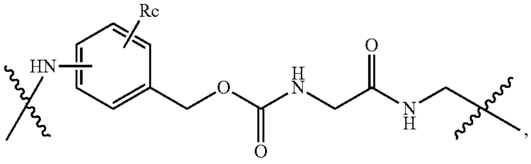

wherein $R_c$ is independently at each occurrence absent or a group selected from

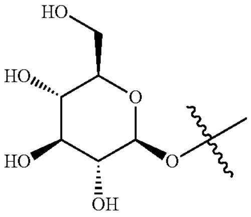

and

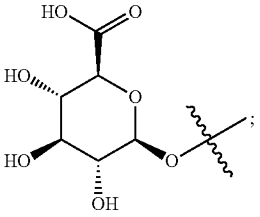

M is absent or

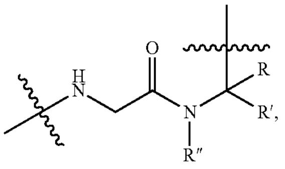

where R, R', and R" are independently at each occurrence hydrogen or a $C_1$-$C_4$ alkyl, or wherein R' and R" together form a 5-membered or a 6-membered ring; and Dxd is an anti-tumor agent having a structure according to Formula (P):

(P)

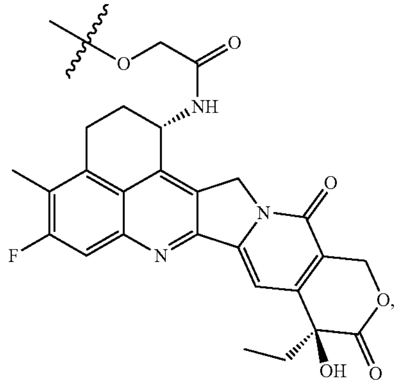

and p is an integer from 1 to 12.

In another aspect, the present disclosure provides a compound according to Formula (L2'-P):

$$H_2N\text{-SP1-B2-(-SP2-AA-SP3-M-Dxd)}p \quad \text{(L2'-P)},$$

wherein:

B" is selected from the group consisting of —$N_3$,

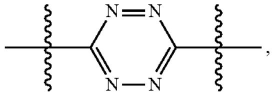 ,
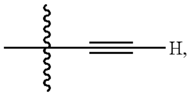
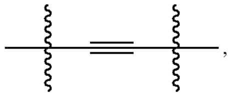
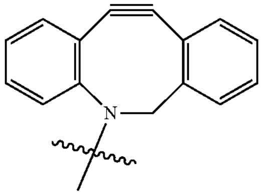 and 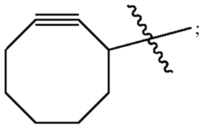

SP1 is absent or a first spacer unit selected from the group consisting of

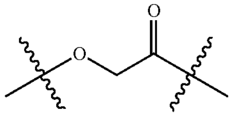 and

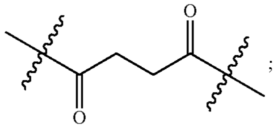

B2 is absent or a branching unit;

SP2 is absent or a second spacer unit selected from the group consisting of a $C_{1-6}$ alkyl, —$(CH_2—CH_2—O)_v$—, —NH—, —C(O)—, —NH—C(O)—, —NH—$(CH_2)_u$—, —NH—$(CH_2)_u$—C(O)—, —NH—$(CH_2—CH_2—O)_v$—, —NH—$(CH_2—CH_2—O)_v$—C(O)—, —NH—$(CH_2—CH_2—O)_v$—$(CH_2)_u$—, —NH—$(CH_2—CH_2—O)_v$—$(CH_2)_u$—C(O)—, —$(CH_2)_u$—NH—C(O)—, —NH—$(CH_2)_u$—NH—C(O)—, —NH—$(CH_2)_u$—C(O)—NH—, or combinations thereof; wherein subscripts u and v are independently an integer from 1 to 8;

AA is absent or a peptide unit comprising from 2 to 4 amino acids;

SP3 is absent or a third spacer unit selected from the group consisting of,

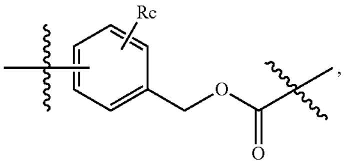

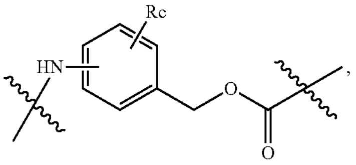

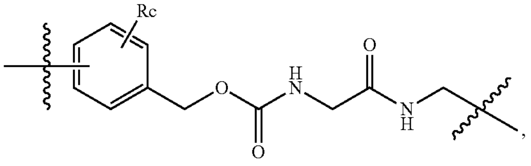

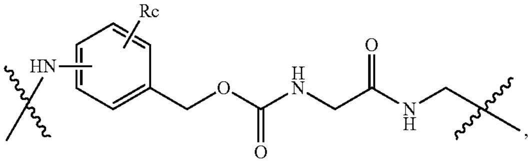

wherein $R_c$ is independently at each occurrence absent or a group selected from

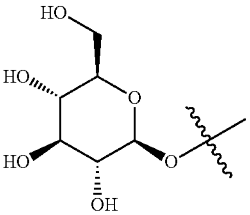 and

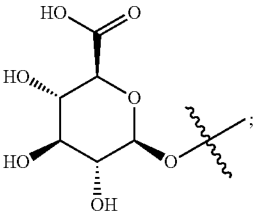

M is absent or

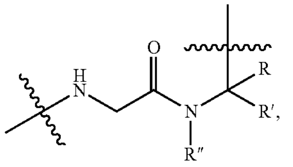

where R, R', and R" are independently at each occurrence hydrogen or a $C_1$-$C_4$ alkyl, or wherein R' and R" together form a 5-membered or a 6-membered ring; and Dxd is an anti-tumor agent having a structure according to Formula (P):

(P)

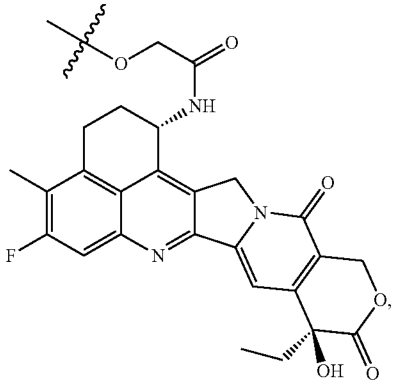

and p is an integer from 1 to 12.

In another aspect, the present disclosure provides a compound according to Formula (L2"-P):

Maleimide-N-SP1-B2-(-SP2-AA-SP3-M-Dxd)*p* (L2"-P), wherein:

B" is selected from the group consisting of $—N_3$,

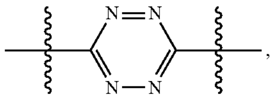

,

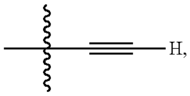

,

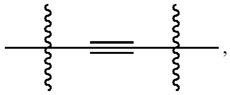

,

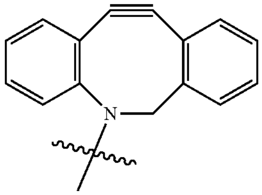

and

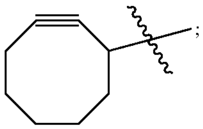

;

SP1 is absent or a first spacer unit selected from the group consisting of

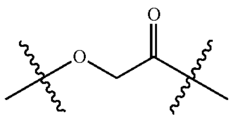

and

-continued

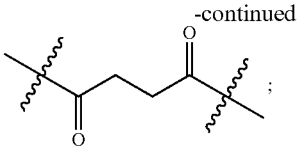

;

B2 is absent or a branching unit;

SP2 is absent or a second spacer unit selected from the group consisting of a $C_{1-6}$ alkyl, $—(CH_2—CH_2—O)_v—$, —NH—, —C(O)—, —NH—C(O)—, $—NH—(CH_2)_u—$, $—NH—(CH_2)_u—C(O)—$, $—NH—(CH_2—CH_2—O)_v—$, $—NH—(CH_2—CH_2—O)_v—C(O)—$, $—NH—(CH_2—CH_2—O)_v—(CH_2)_u—$, $—NH—(CH_2—CH_2—O)_v—(CH_2)_u—C(O)—$, $—(CH_2)_u—NH—C(O)—$, $—NH—(CH_2)_u—NH—C(O)—$, $—NH—(CH_2)_u—C(O)—NH—$, or combinations thereof; wherein subscripts u and v are independently an integer from 1 to 8;

AA is absent or a peptide unit comprising from 2 to 4 amino acids;

SP3 is absent or a third spacer unit selected from the group consisting of,

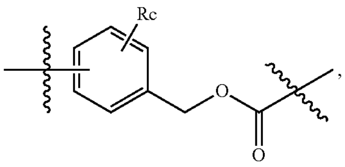

,

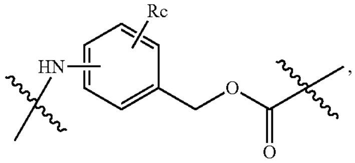

,

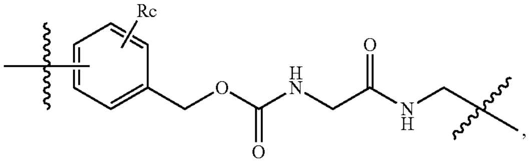

,

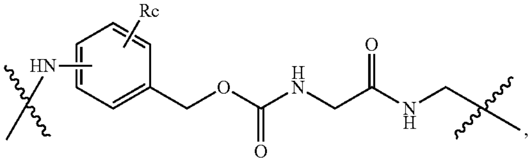

, wherein $R_c$ is independently at each occurrence absent or a group selected from

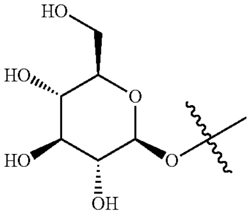

and

-continued

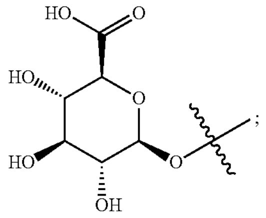

M is absent or

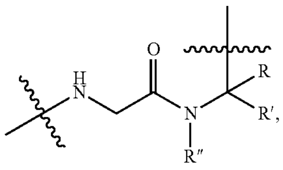

where R, R', and R" are independently at each occurrence hydrogen or a $C_1$-$C_4$ alkyl, or wherein R' and R" together form a 5-membered or a 6-membered ring; and Dxd is an anti-tumor agent having a structure according to Formula (P):

(P)

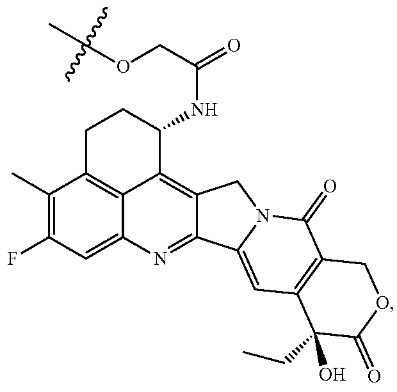

and p is an integer from 1 to 12.

In certain embodiments, the linker-payload L2-P, L2'-P, L2"-P according to the disclosure has a structure selected from the group consisting of:

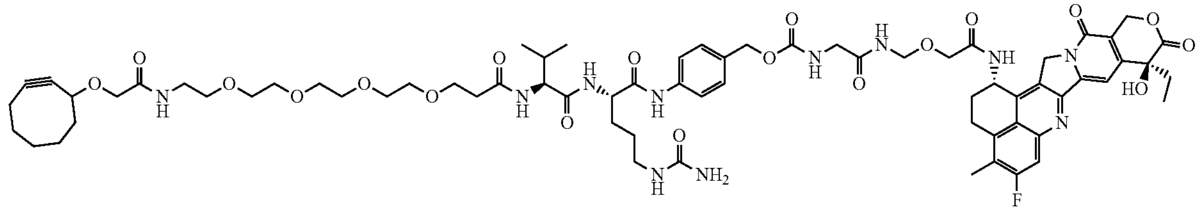

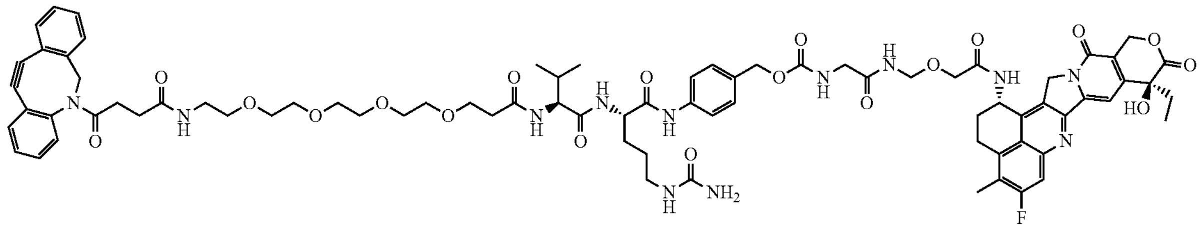

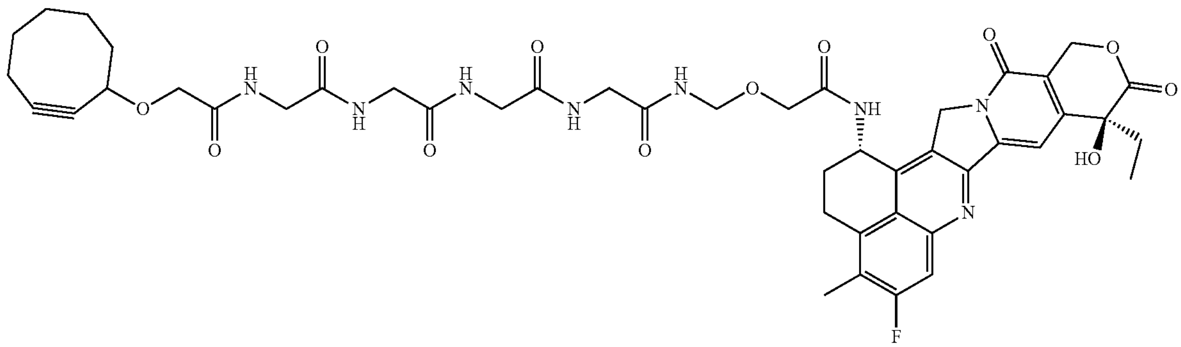

-continued
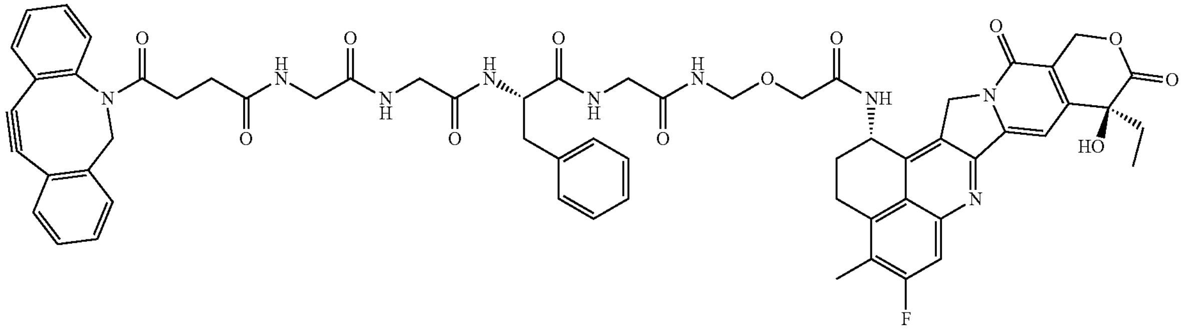
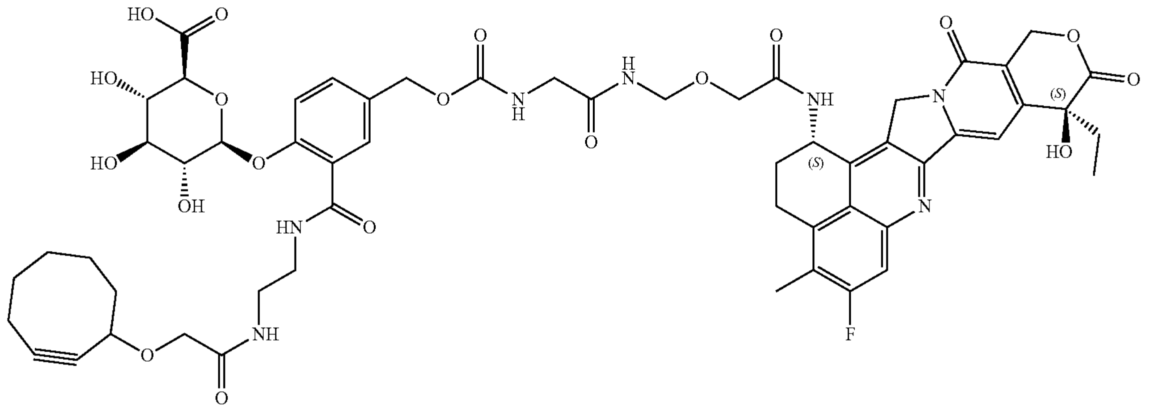
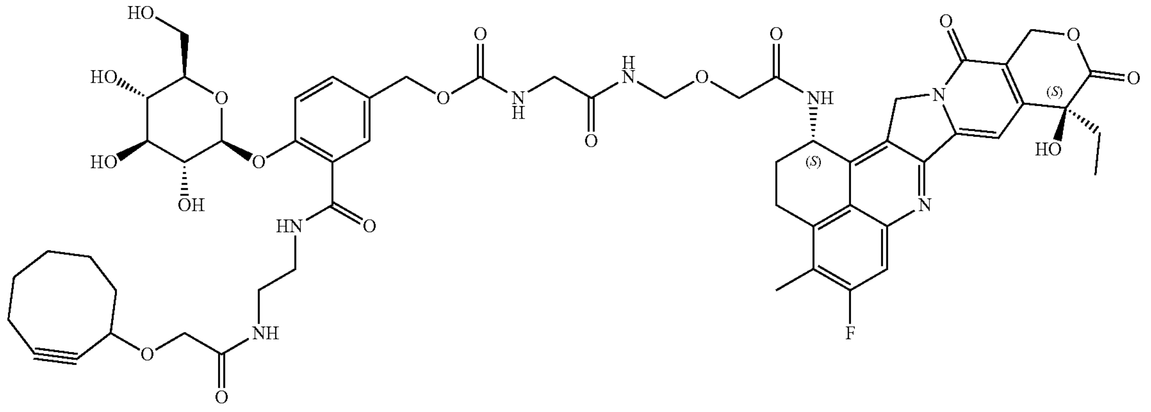
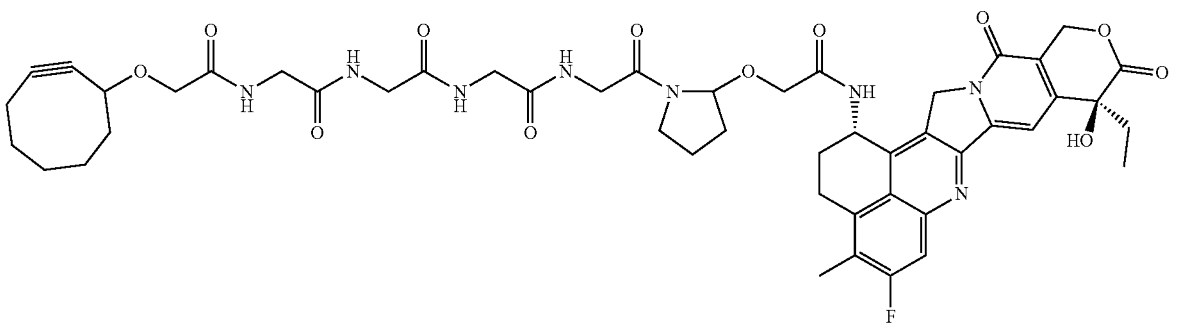

-continued
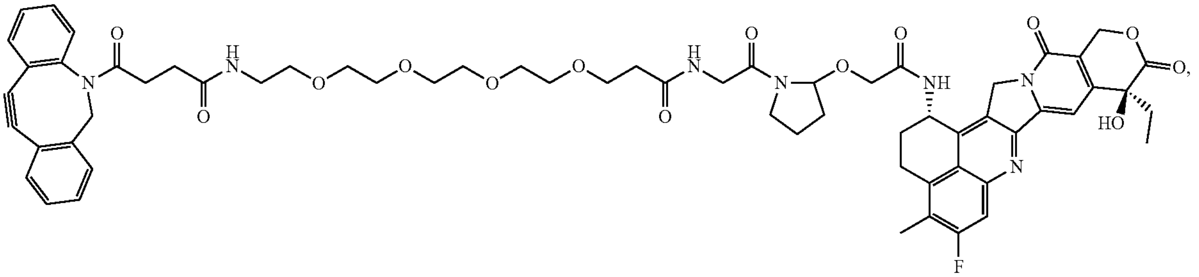
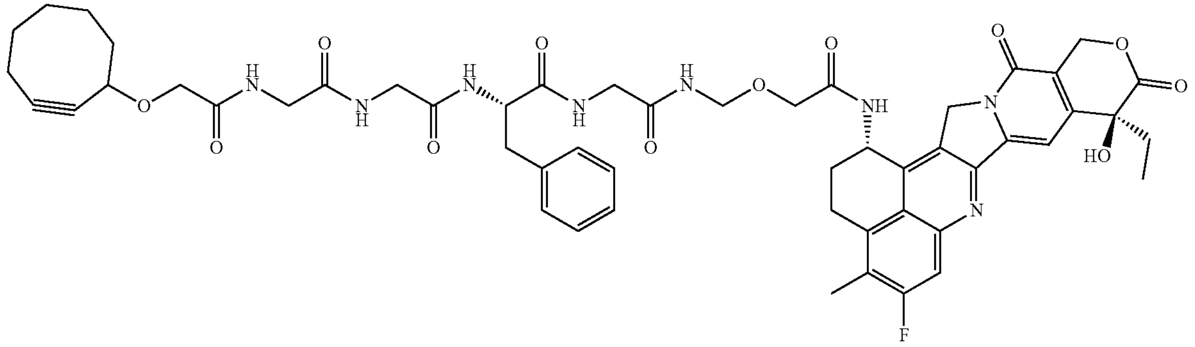
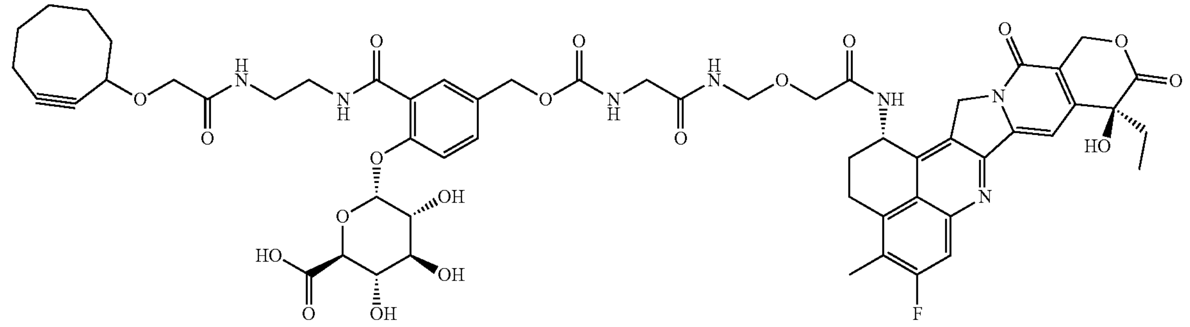
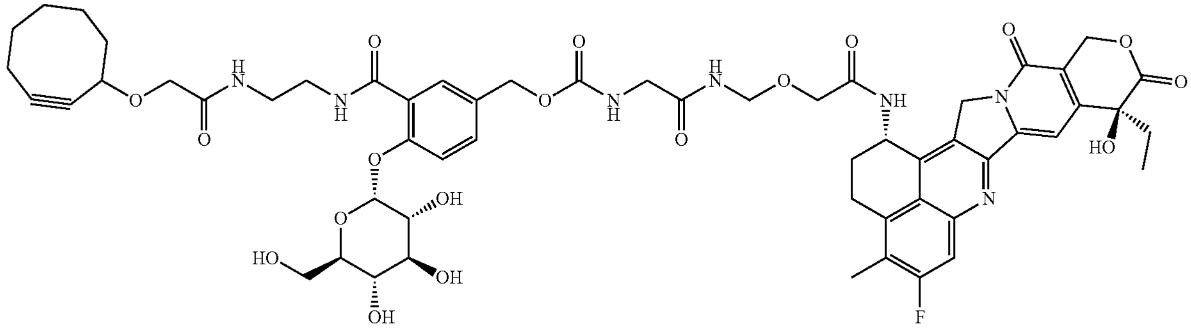
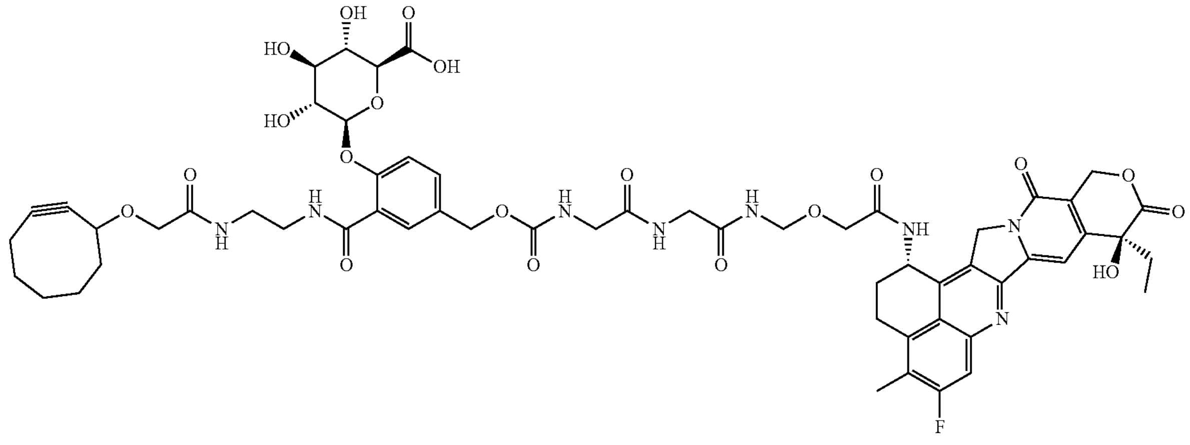

-continued
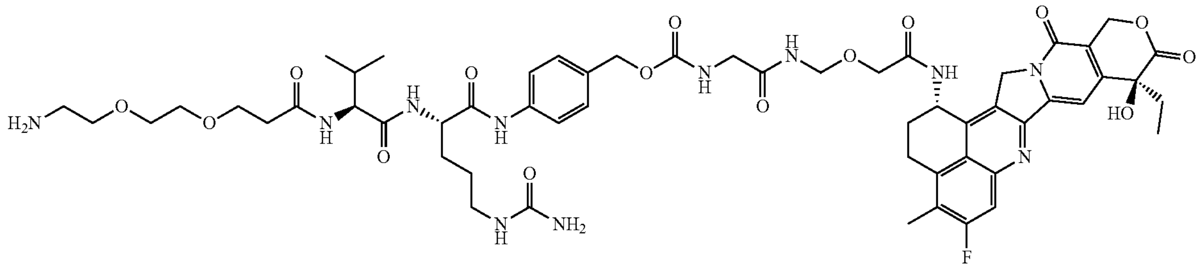
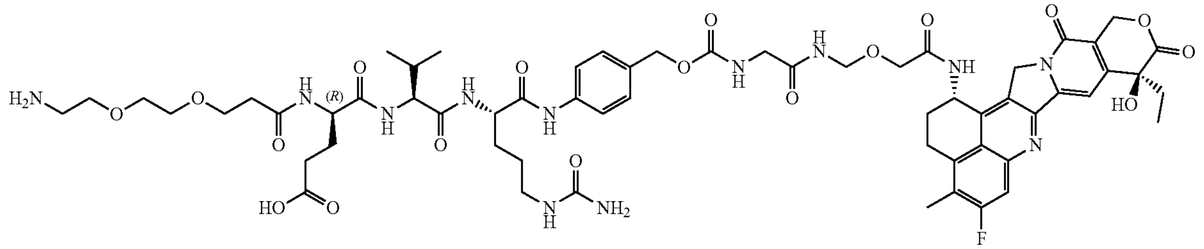
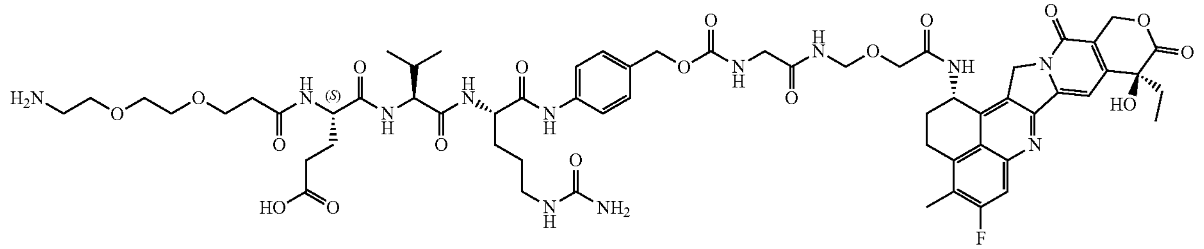
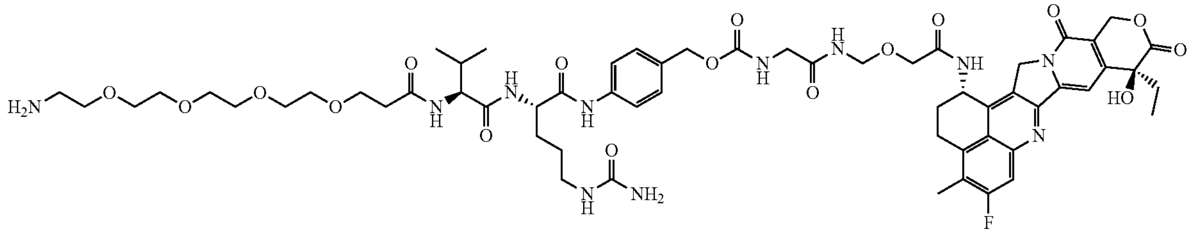
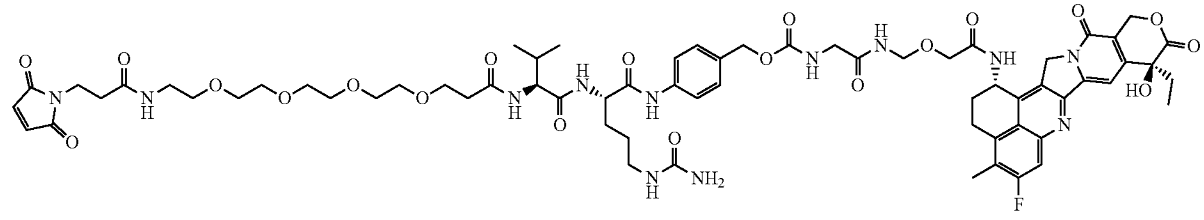
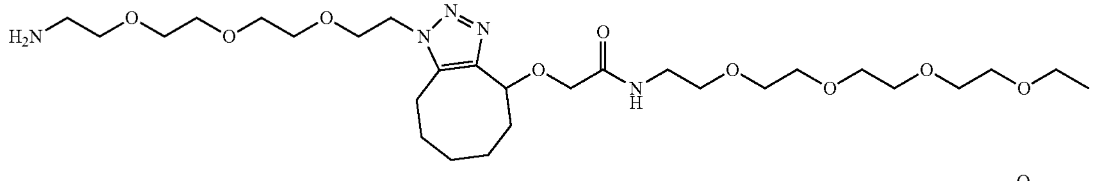
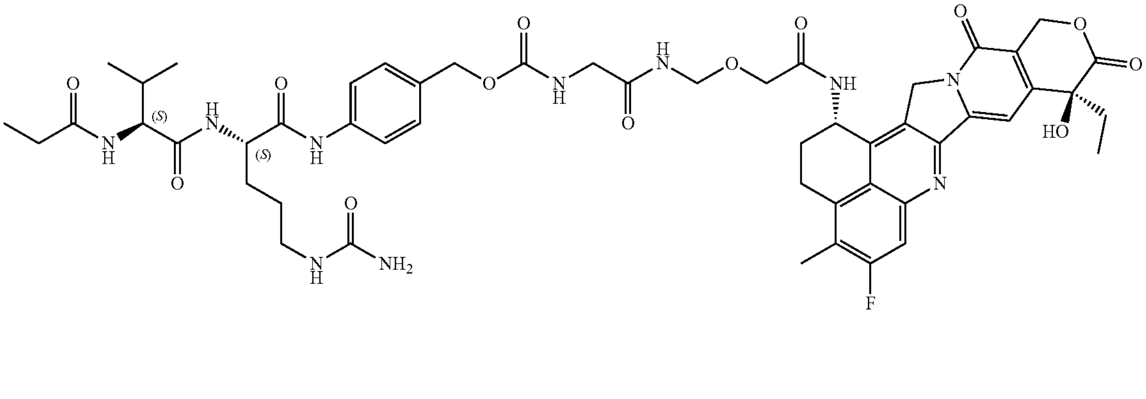

-continued
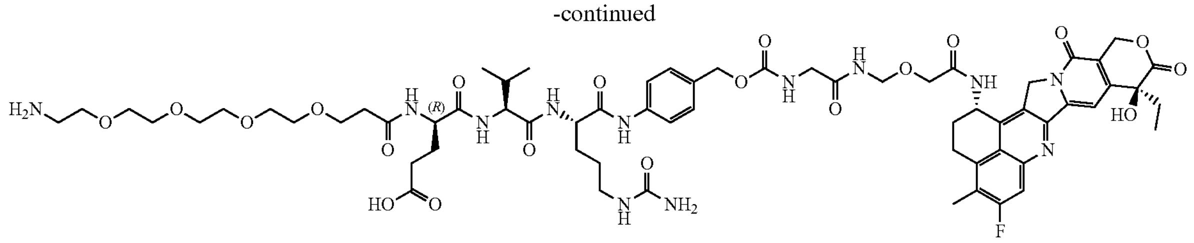
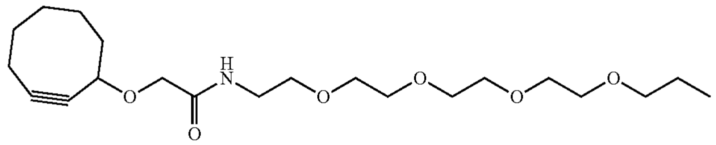
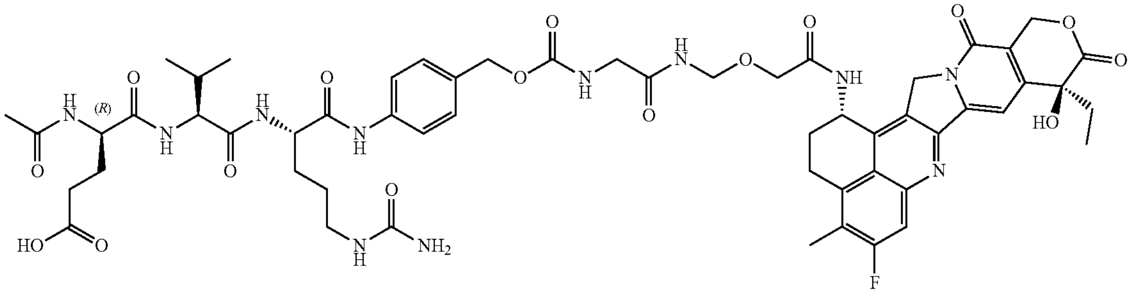
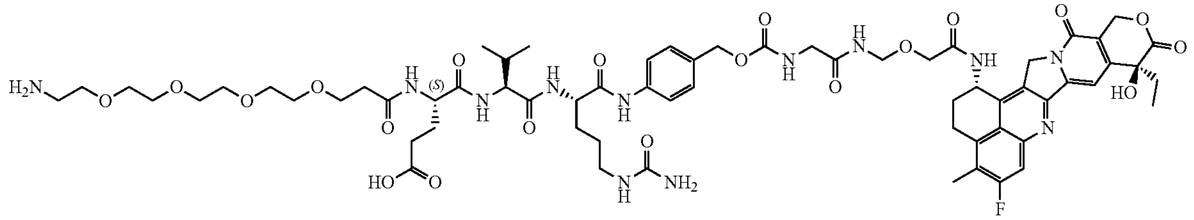
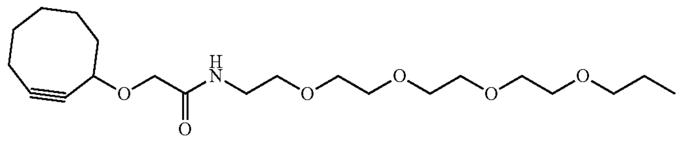
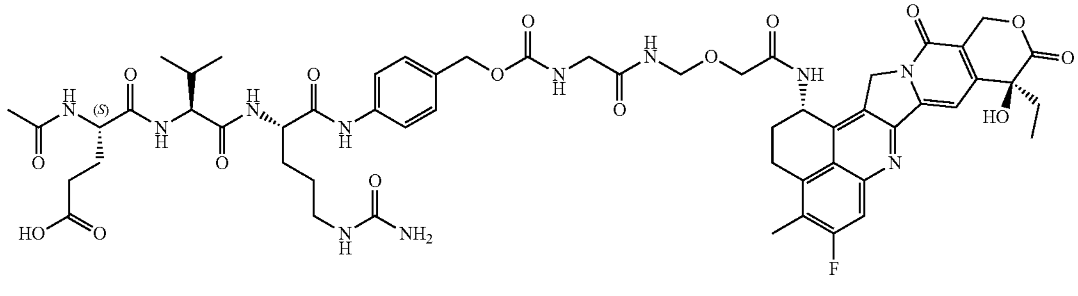
or a pharmaceutically acceptable salt thereof.
Branched Linker2-Payloads (BL2P)
In another aspect, the present disclosure provides L2-P which comprise one or more branching units. Exemplary branching units B1-B5 according to the disclosure are depicted below.

| Branch B | B1 | B2 |
| --- | --- | --- |
| Structure | 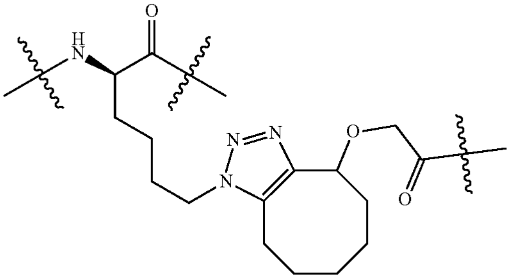 [SMILES: *N[C@H](CCCCn1nnc2c1CCCCCC2OCC(*)=O)C(*)=O] | 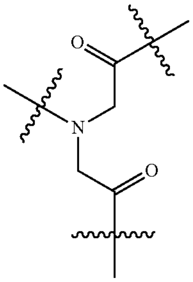 [SMILES: *C(=O)CN(*)CC(*)=O] |
| Branch B | B3 | B4 |
| --- | --- | --- |
| Structure | 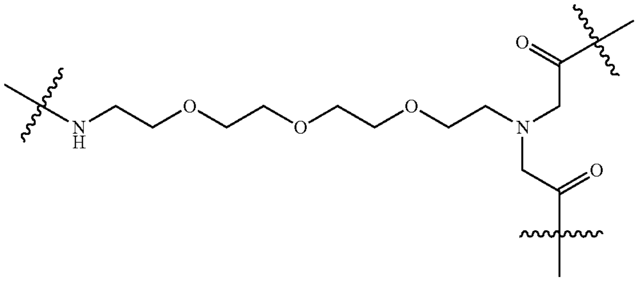 [SMILES: *NCCOCCOCCOCCN(CC(*)=O)CC(*)=O] | 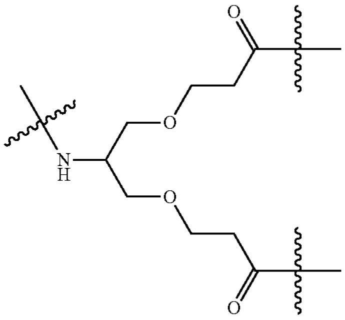 [SMILES: *NC(COCCC(*)=O)COCCC(*)=O] |
| Branch B | B5 |
| --- | --- |
| Structure | 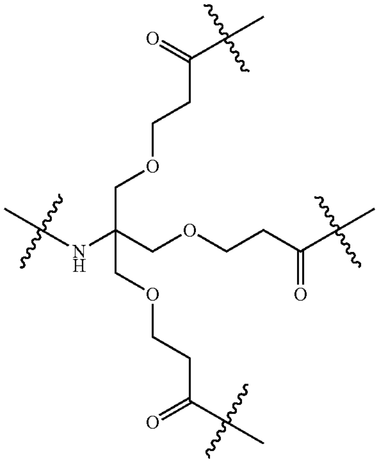 [SMILES: *NC(COCCC(*)=O)(COCCC(*)=O)COCCC(*)=O] |
Structures for exemplary branched linker2-payloads (BL2P) according to the disclosure are provided below.

Structures
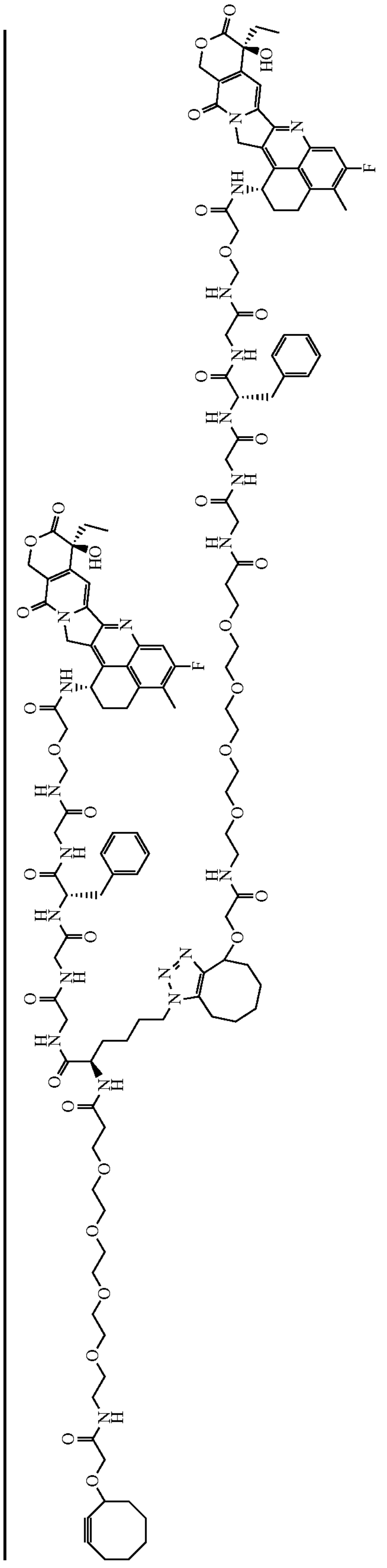
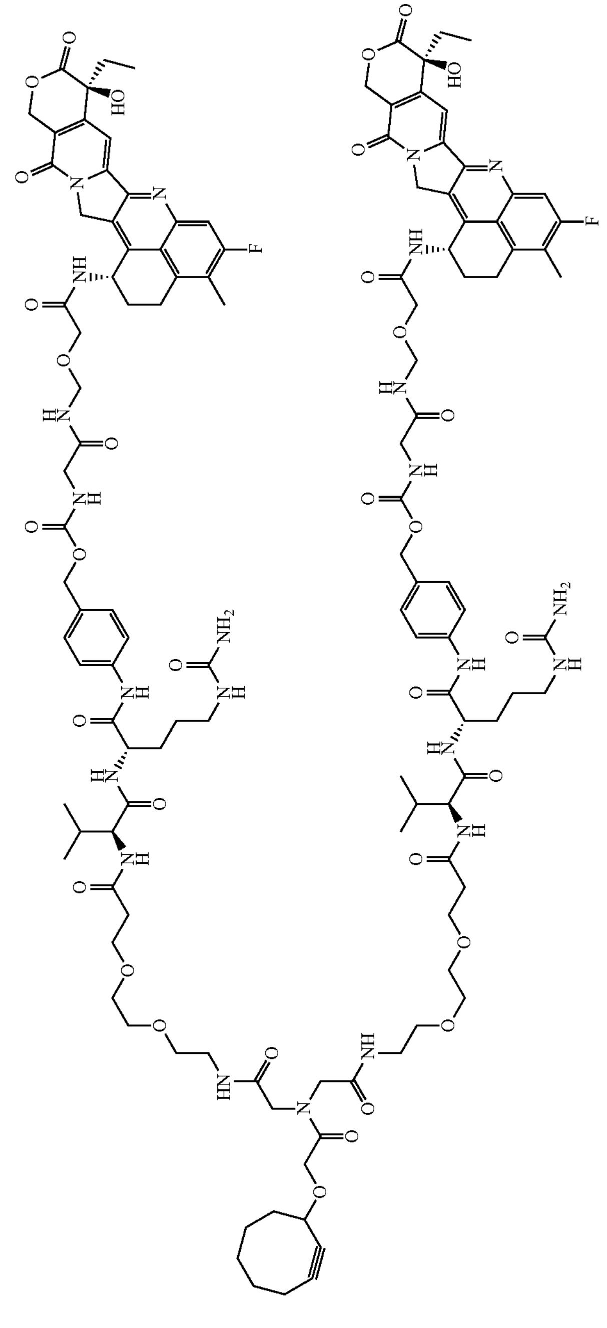

-continued
Structures
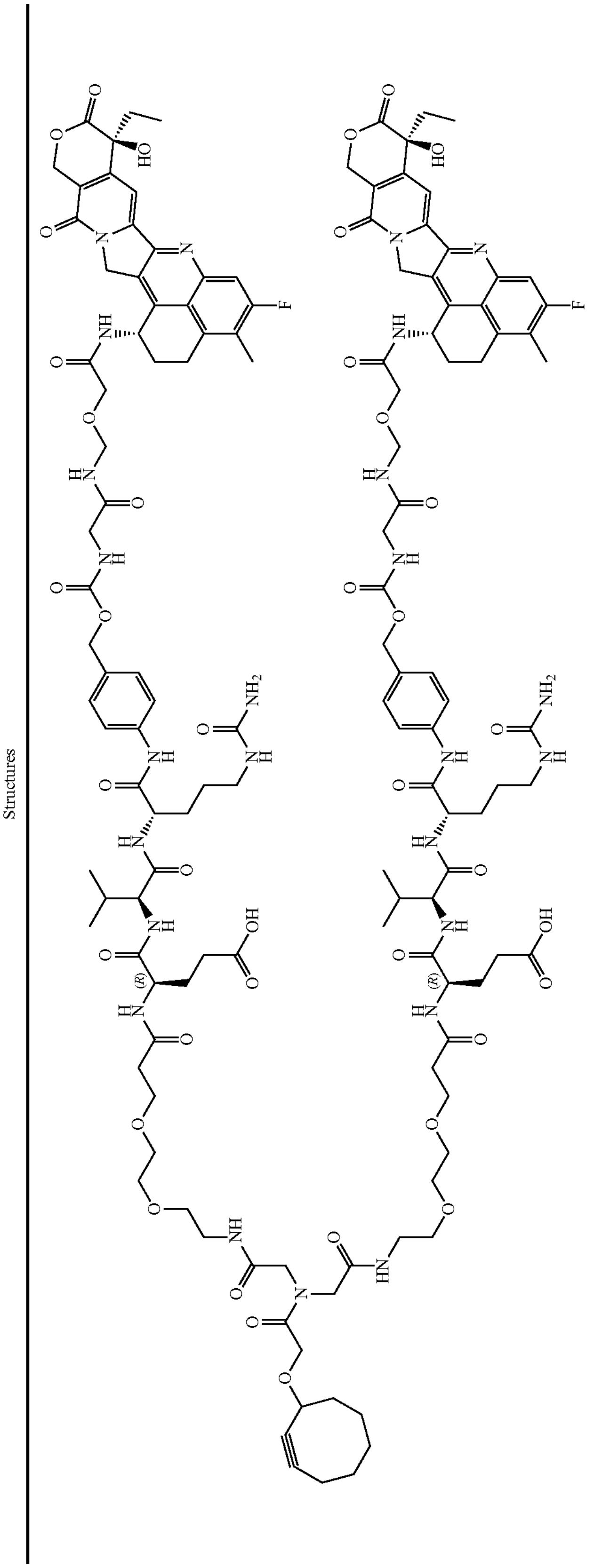

-continued
Structures
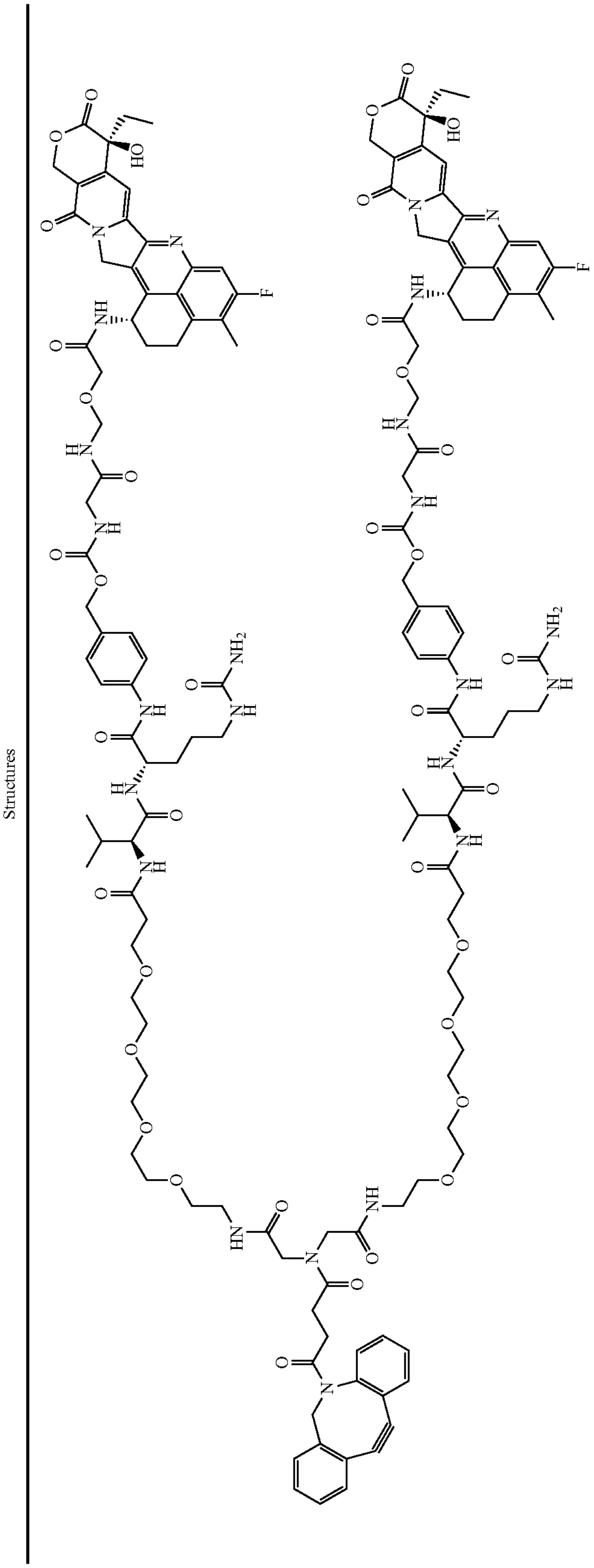

-continued
| Structures |
| --- |
| 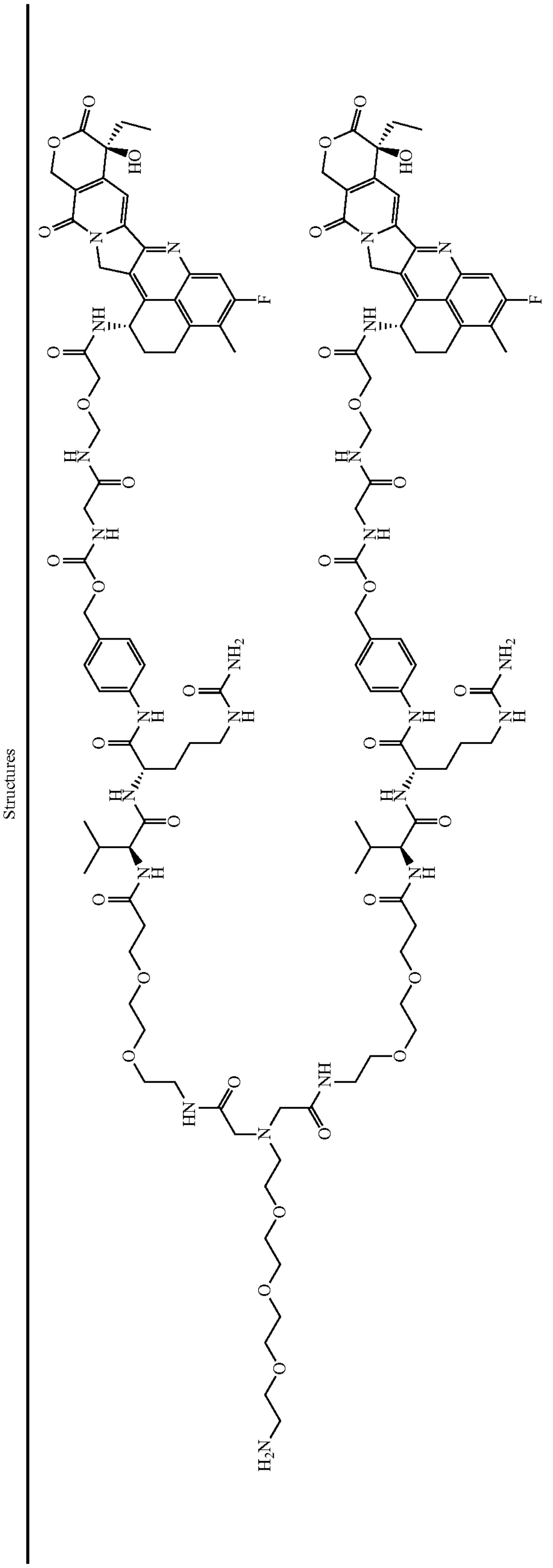 |
| 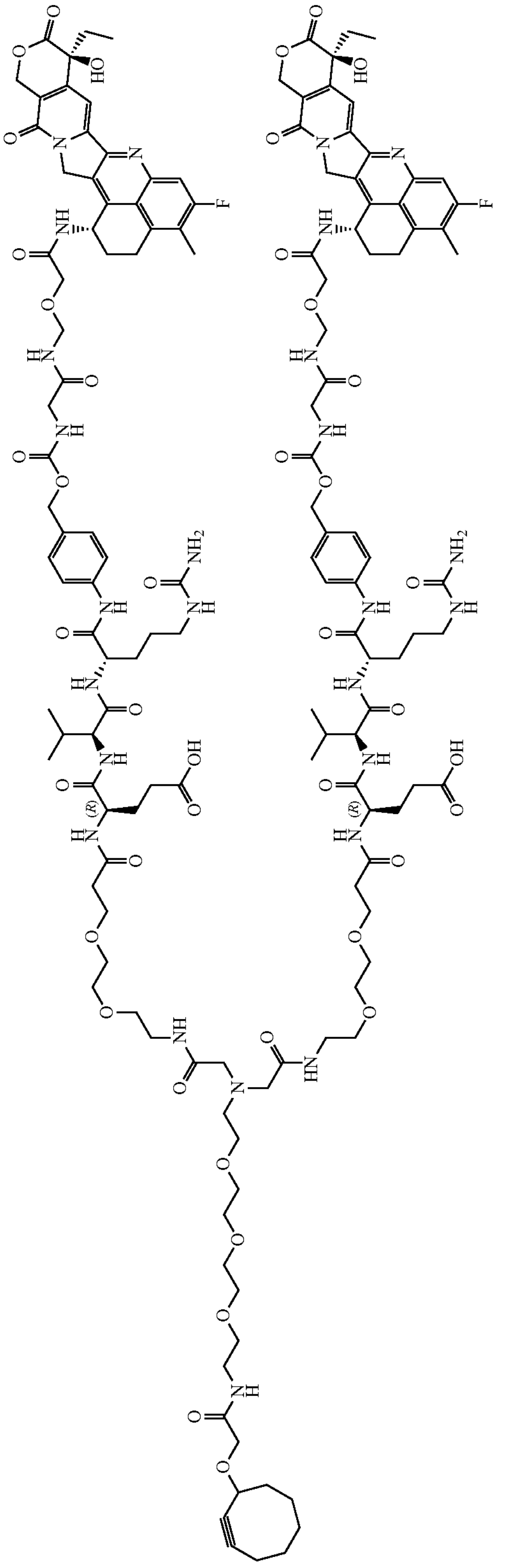 |

-continued
Structures
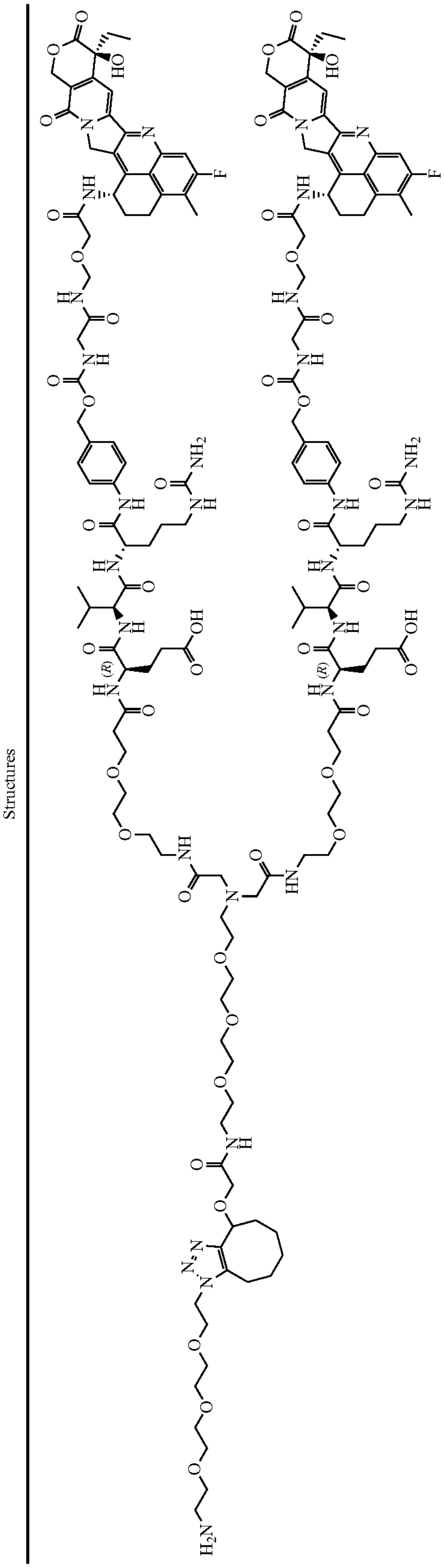
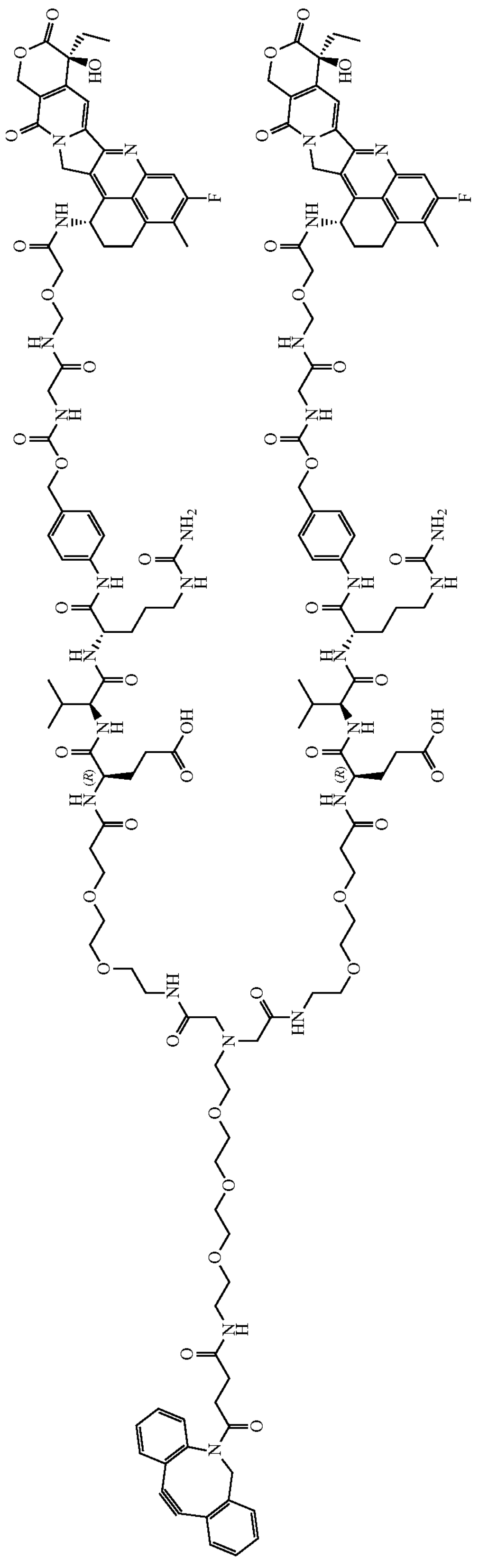

-continued
Structures
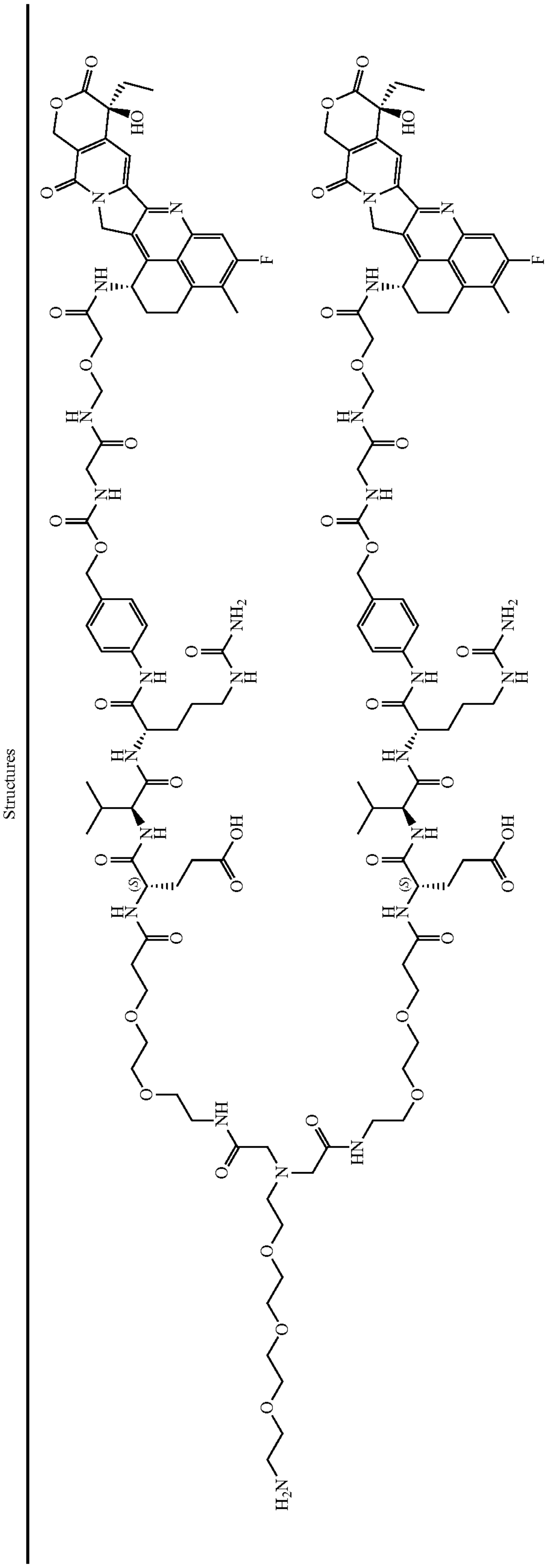
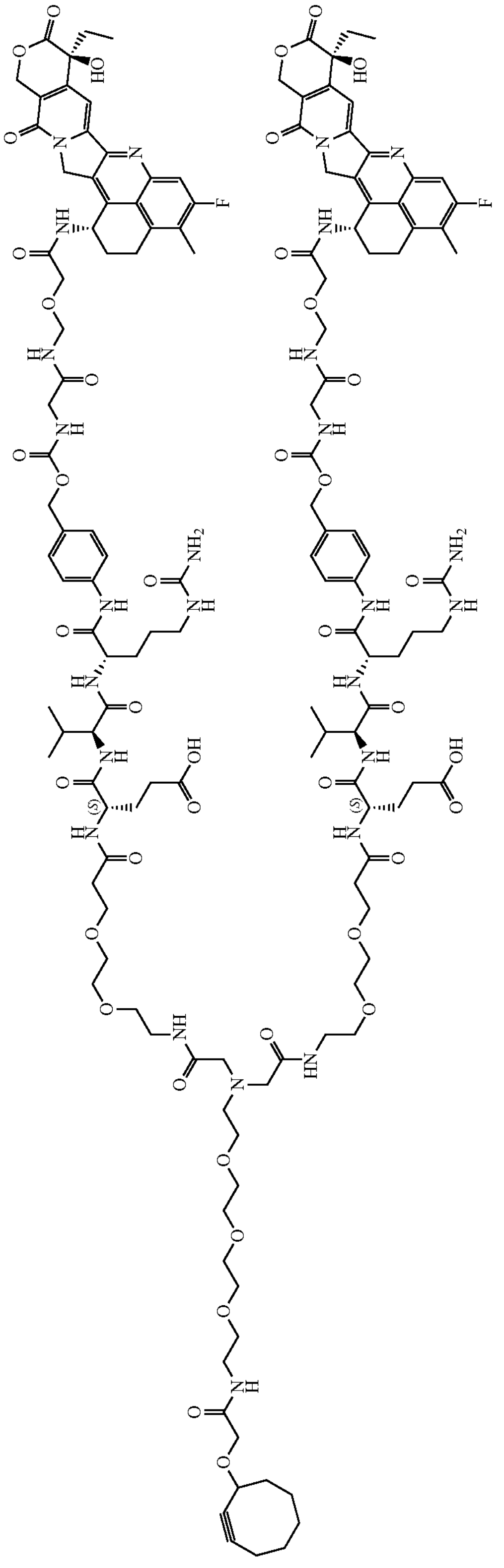

-continued
Structures
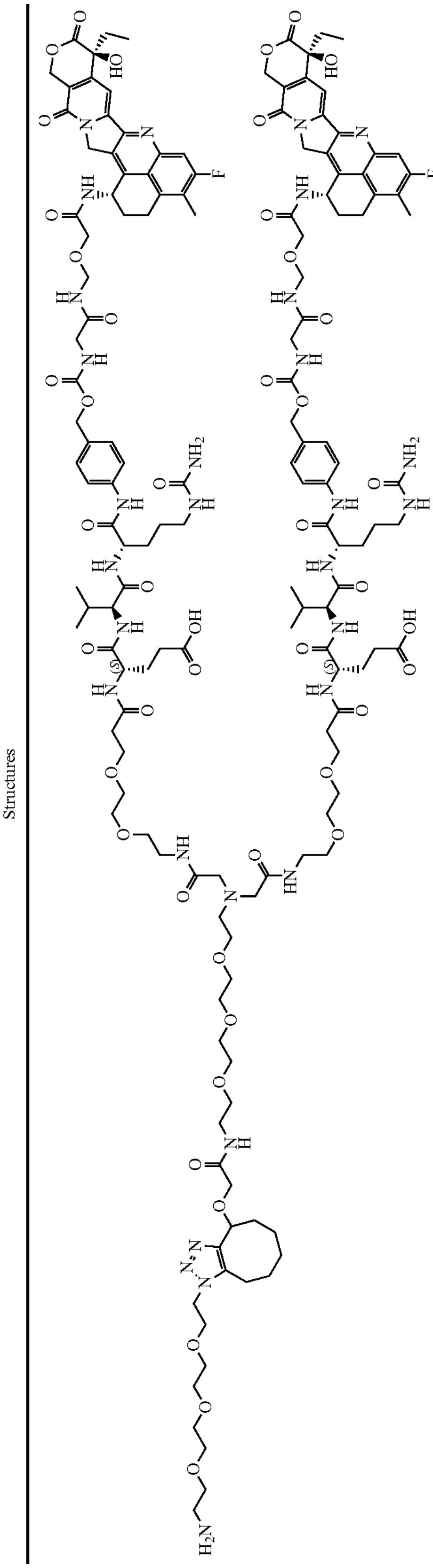
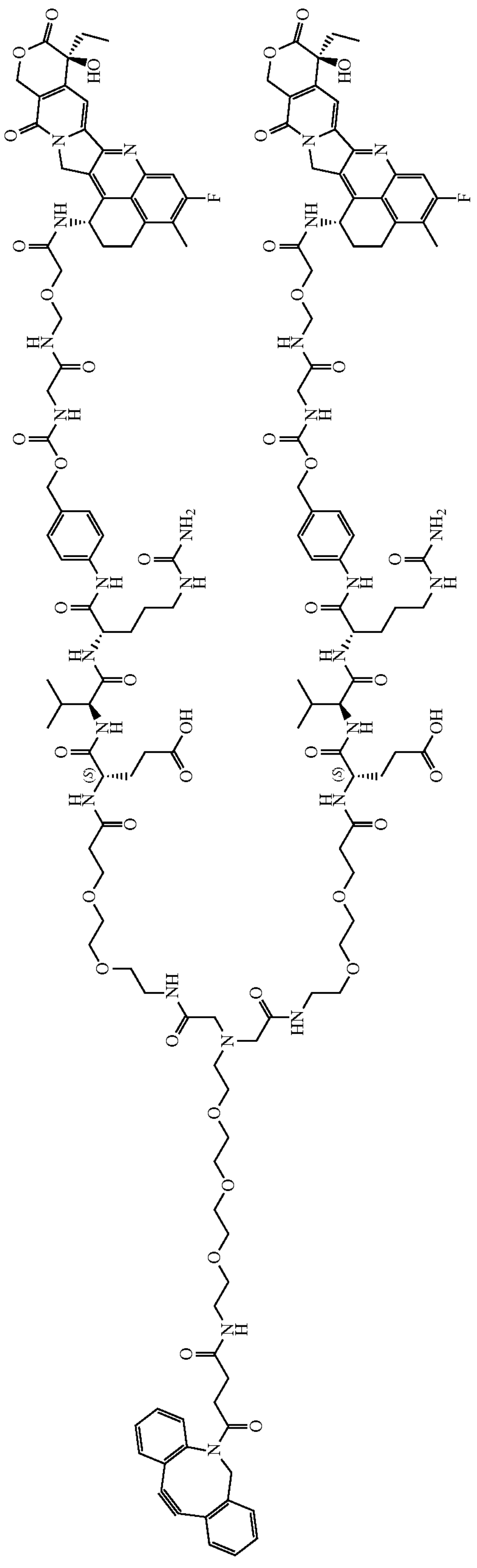

-continued
Structures
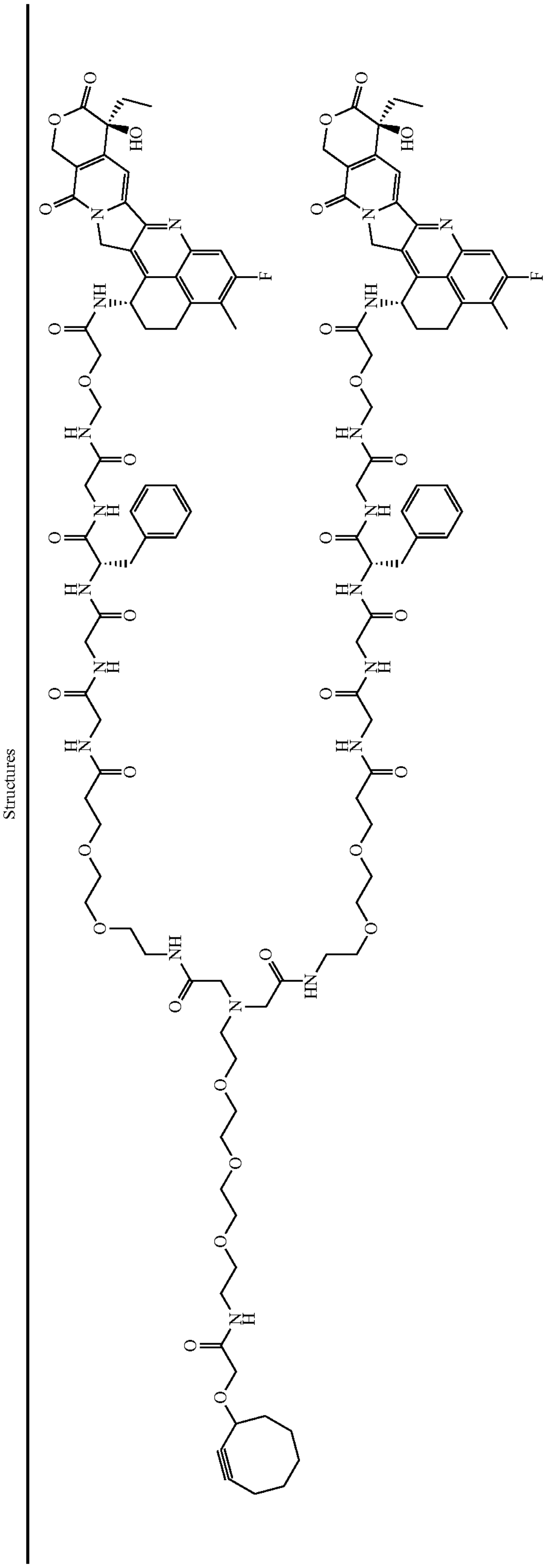

-continued
| Structures |
| --- |
| 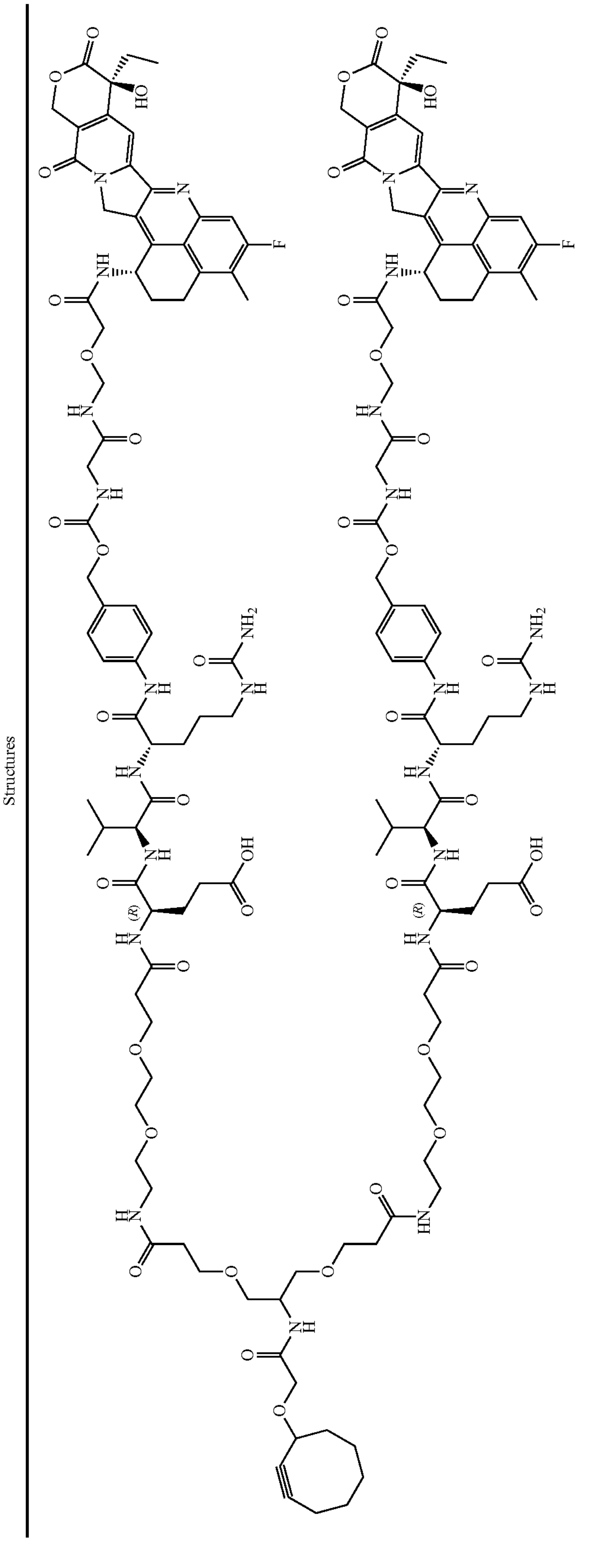 |

-continued
| Structures |
| --- |
| 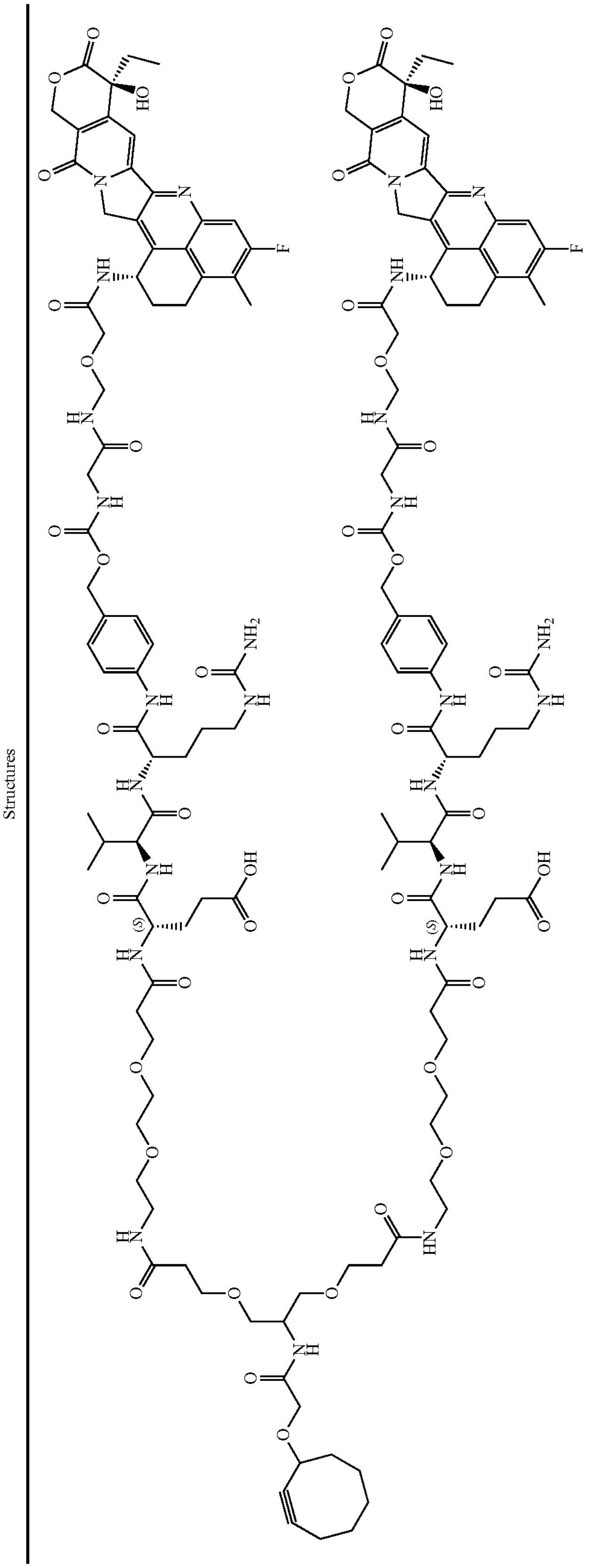 |

-continued
| Structures |
| --- |
| 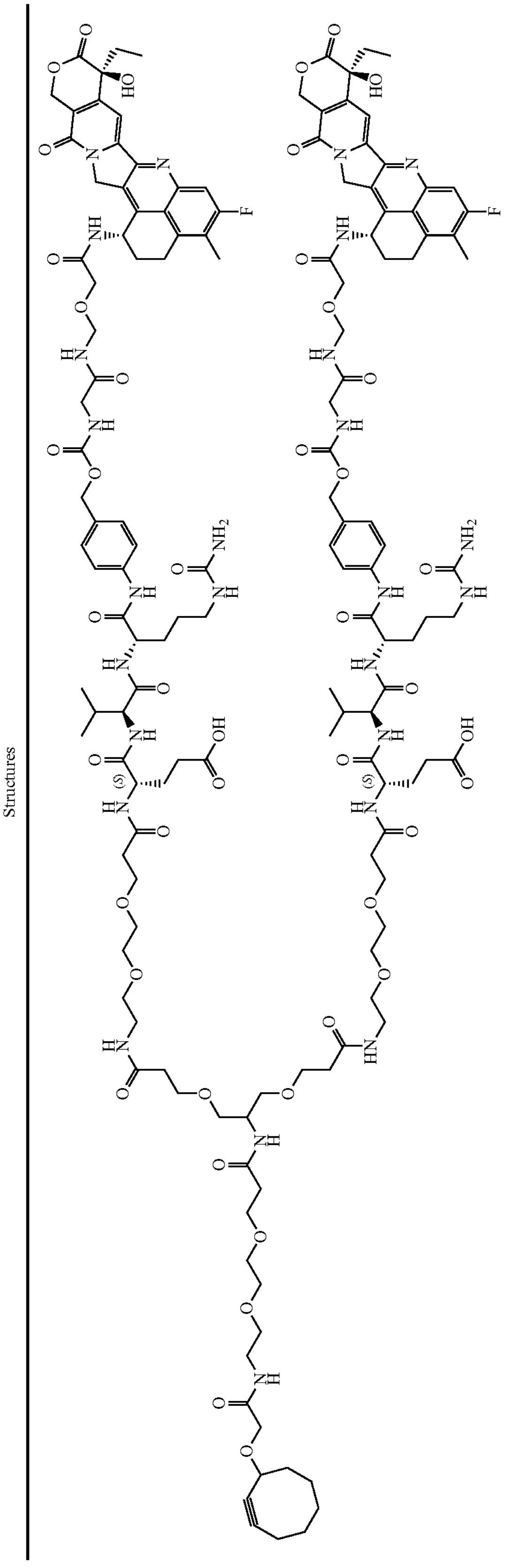 |
| 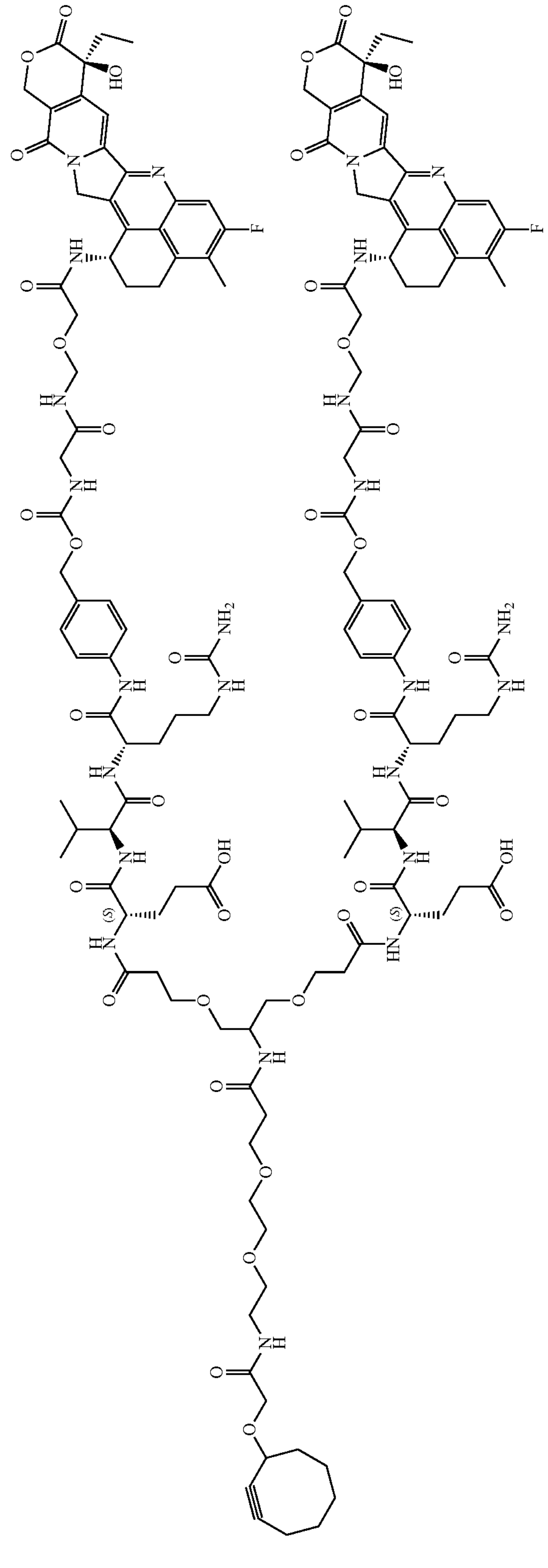 |

-continued
| Structures |
| --- |
| 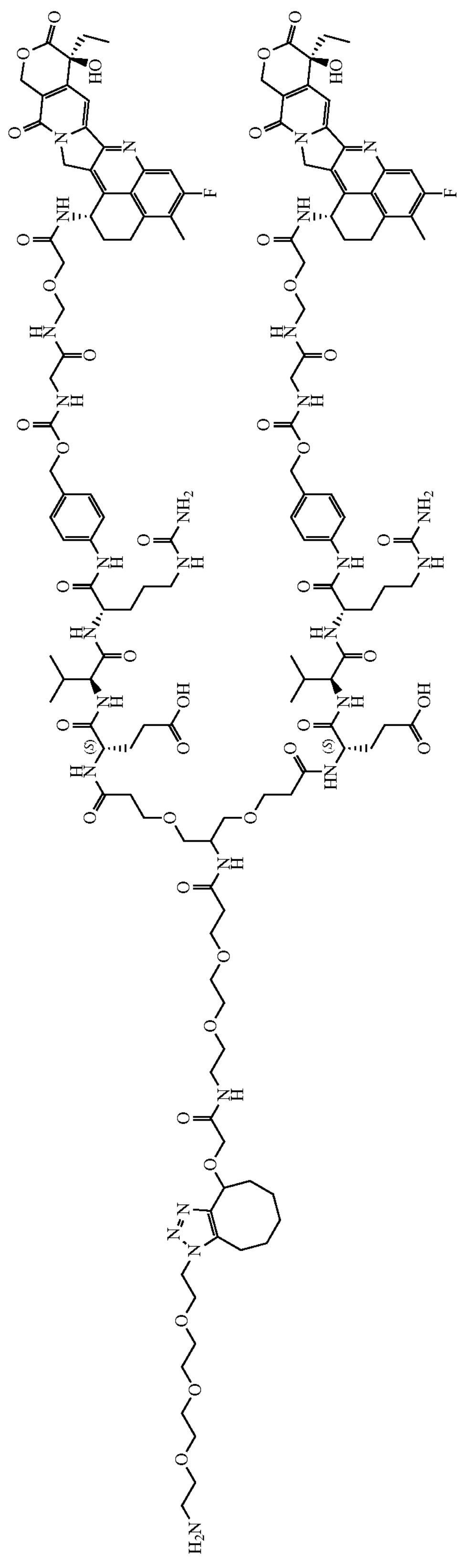 |

-continued
| Structures |
| --- |
| 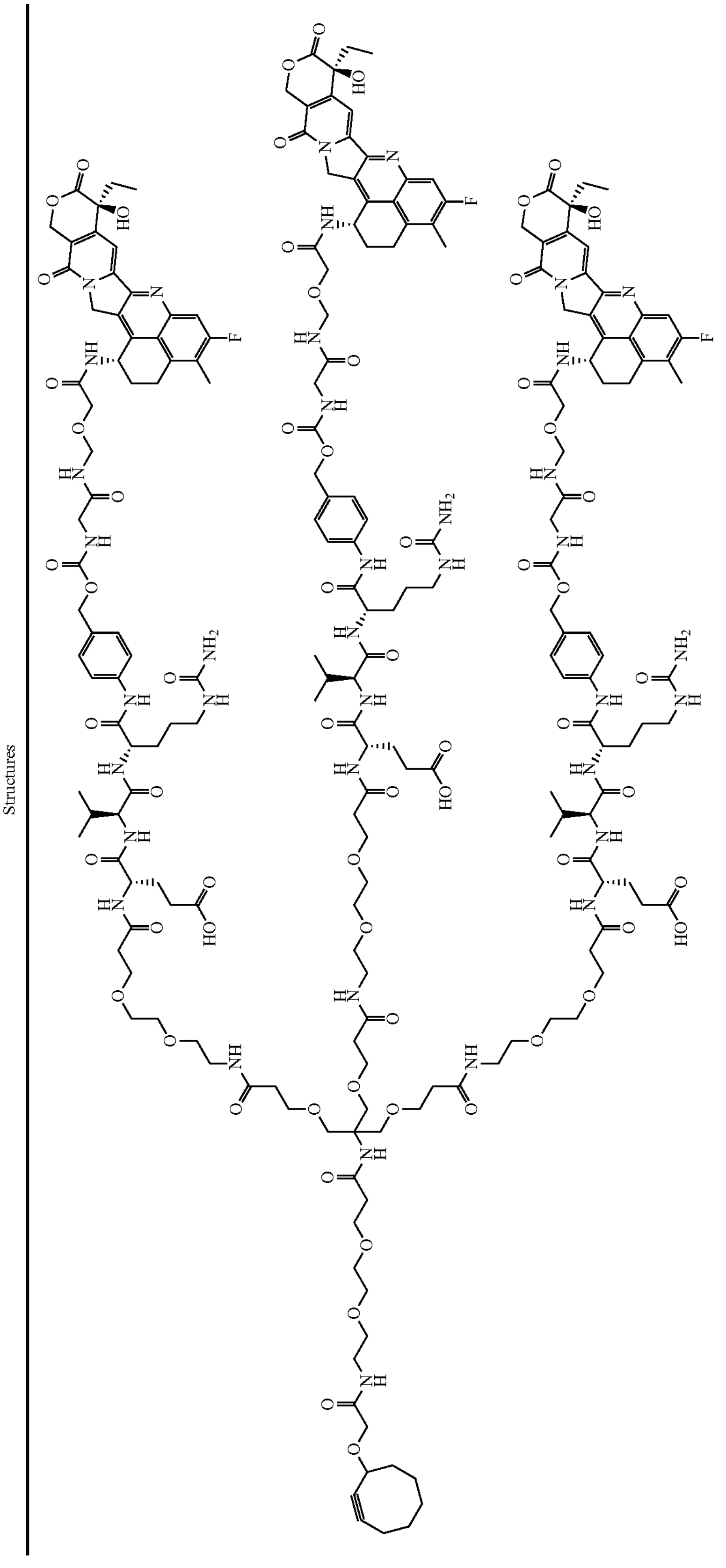 |

-continued
| Structures |
|---|
| 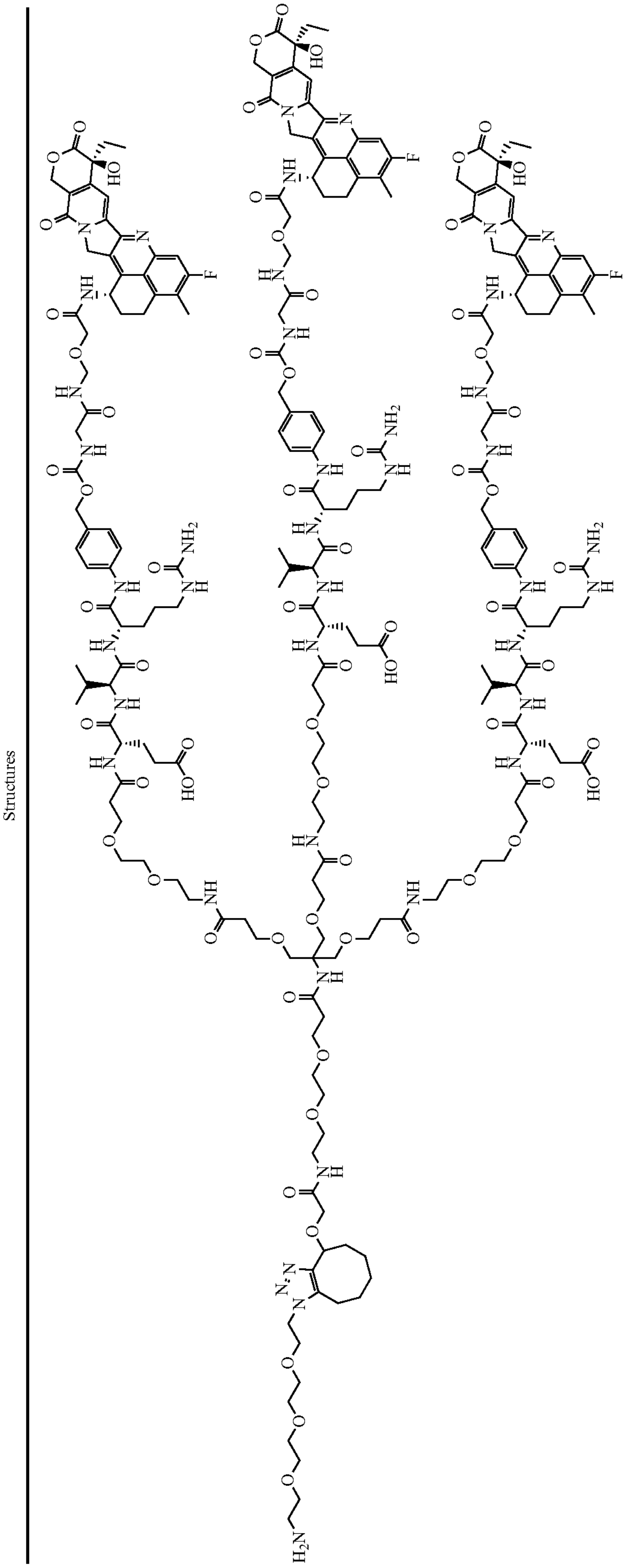 |

In one embodiment, the compound (i.e., the linker-payload) according to the disclosure has the structure:

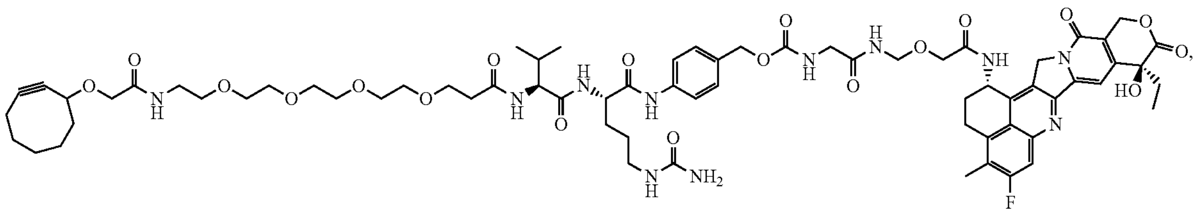 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)OCc1ccc(NC(=O)[C@H](CCCNC(N)=O)NC(=O)[C@@H](NC(=O)CCOCCOCCOCCOCCNC(=O)COC2C#CCCCCC2)C(C)C)cc1)CC3]

or a pharmaceutically acceptable salt thereof.

In one embodiment, the compound (i.e., the linker-payload) according to the disclosure has the structure:

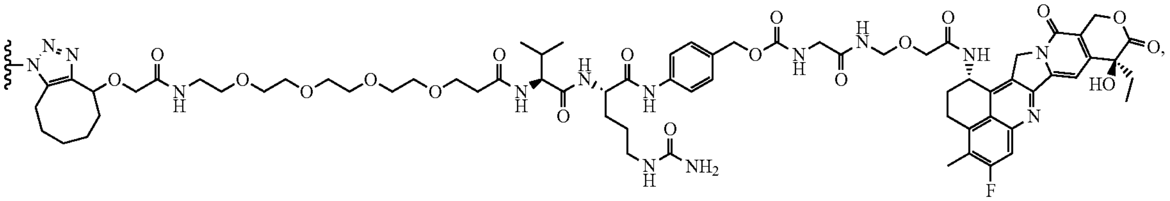

or

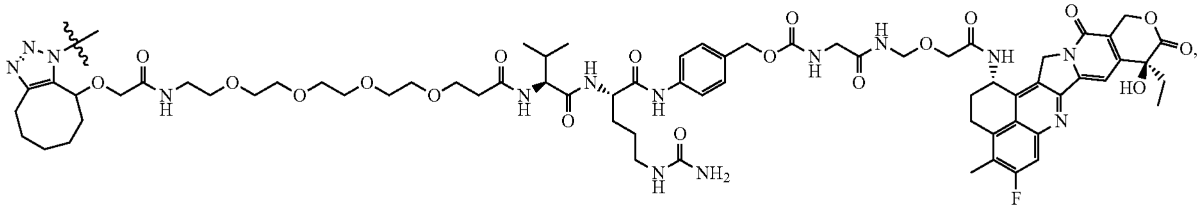

or a pharmaceutically acceptable salt thereof.

In another aspect, the present disclosure provides an antibody-drug conjugate according to Formula (II):

$$\text{Ab-(Gln-NH-L1-B-(SP1-B2-(-SP2-AA-SP3-M-Dxd)}_k)_p)_n \quad \text{(II)},$$

wherein Ab is an antibody; Gln is a glutamine residue; L1 is absent or a first linker as described above; B is a branching unit as described above comprising at least one adduct of group B' and group B", where the group B' is selected from —N,

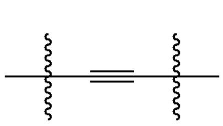

,

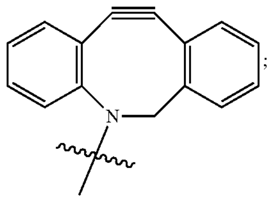

;

-continued

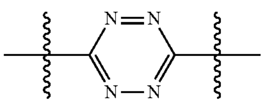

;

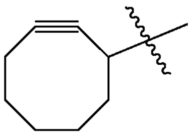

and at least one group B", wherein B"-SP1-B2-(-SP2-AA-SP3-M-Dxd)p is the compound according to formula (L2-P) as described above, and wherein the compound of formula (L2-P) is covalently attached to the antibody via the adduct of the group B' and the group B", k is an integer from 1 to 12, and p and n are independently an integer from 1 to 30.

In one embodiment, the antibody-drug conjugate according to the present disclosure comprises an antibody and a linker-payload, wherein the linker-payload comprises the structure:

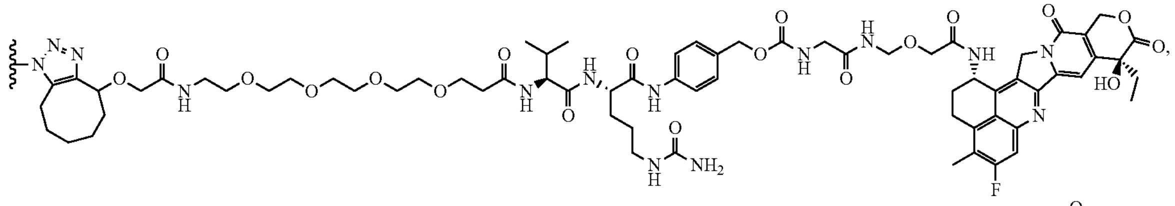

or

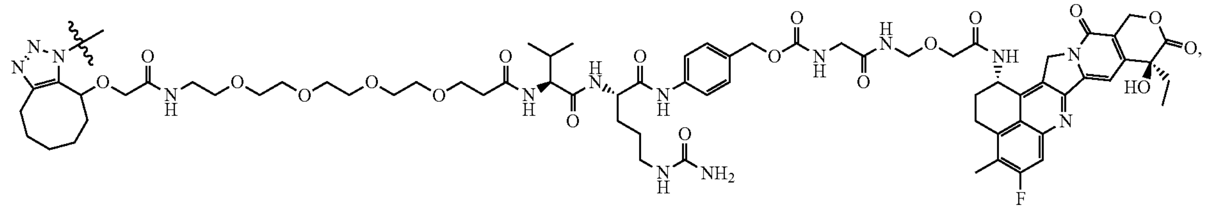

, or a pharmaceutically acceptable salt thereof, where represents the point of attachment to the binding agent (e.g., an antibody), directly or through a second linker.

Binding Agents

In one embodiment, the effectiveness of the protein-drug conjugate embodiments described herein depend on the selectivity of the binding agent to bind its binding partner. In one embodiment of the present disclosure, the binding agent is any molecule capable of binding with some specificity to a given binding partner. In one embodiment, the binding agent is within a mammal where the interaction can result in a therapeutic use. In an alternative embodiment, the binding agent is in vitro where the interaction can result in a diagnostic use. In some aspects, the binding agent is capable of binding to a cell or cell population.

Suitable binding agents of the present disclosure include proteins that bind to a binding partner, wherein the binding agent comprises one or more glutamine residues. Suitable binding agents include, but are not limited to, antibodies, lymphokines, hormones, growth factors, viral receptors, interleukins, or any other cell binding or peptide binding molecules or substances.

In one embodiment the binding agent is an antibody. In certain embodiments, the antibody is selected from monoclonal antibodies, polyclonal antibodies, antibody fragments (Fab, Fab', and F(ab)2, minibodies, diabodies, triabodies, and the like). Antibodies herein can be humanized using methods described in U.S. Pat. No. 6,596,541 and US Publication No. 2012/0096572, each incorporated by reference in their entirety. In certain embodiments of the protein-drug conjugate compounds of the present disclosure, BA is a humanized monoclonal antibody. For example, BA can be a monoclonal antibody that binds HER2, MET, or STEAP2. In certain embodiments of the protein-drug conjugate compounds of the present disclosure, BA is a bispecific antibody, e.g., an anti-HER2/HER2 bispecific antibody, or an anti-MET/MET bispecific antibody.

In the present disclosure, the antibody can be any antibody deemed suitable to the practitioner of skill. In some embodiments, the antibody comprises at least one glutamine residue in at least one polypeptide chain sequence. In certain embodiments, the antibody comprises one or more gln295 residues. In certain embodiments, the antibody comprises two heavy chain polypeptides, each with one gln295 residue. In further embodiments, the antibody comprises one or more glutamine residues at a site other than a heavy chain 295. Such antibodies can be isolated from natural sources or engineered to comprise one or more glutamine residues. Techniques for engineering glutamine residues into an antibody polypeptide chain are within the skill of the practitioners in the art. In certain embodiments, the antibody is aglycosylated.

The antibody can be in any form known to those of skill in the art. In certain embodiments, the antibody comprises a light chain. In certain embodiments, the light chain is a kappa light chain. In certain embodiments, the light chain is a lambda light chain.

In certain embodiments, the antibody comprises a heavy chain. In some aspects, the heavy chain is an IgA. In some aspects, the heavy chain is an IgD. In some aspects, the heavy chain is an IgE. In some aspects, the heavy chain is an IgG. In some aspects, the heavy chain is an IgM. In some aspects, the heavy chain is an IgG1. In some aspects, the heavy chain is an IgG2. In some aspects, the heavy chain is an IgG3. In some aspects, the heavy chain is an IgG4. In some aspects, the heavy chain is an IgA1. In some aspects, the heavy chain is an IgA2.

In some embodiments, the antibody is an antibody fragment. In some aspects, the antibody fragment is an Fv fragment. In some aspects, the antibody fragment is a Fab fragment. In some aspects, the antibody fragment is a F(ab')2 fragment. In some aspects, the antibody fragment is a Fab' fragment. In some aspects, the antibody fragment is an scFv (sFv) fragment. In some aspects, the antibody fragment is an scFv-Fc fragment.

In some embodiments, the antibody is a monoclonal antibody. In some embodiments, the antibody is a polyclonal antibody.

In some embodiments, the antibody is a chimeric antibody. In some embodiments, the antibody is a humanized antibody. In some embodiments, the antibody is a human antibody.

The antibody can have binding specificity for any antigen deemed suitable to those of skill in the art. In certain embodiments, the antigen is a transmembrane molecule (e.g., receptor) or a growth factor. Exemplary antigens include, but are not limited to, molecules such as renin; a growth hormone, including human growth hormone and bovine growth hormone; growth hormone releasing factor; parathyroid hormone; thyroid stimulating hormone; lipoproteins; alpha1-antitrypsin; insulin A-chain; insulin B-chain; proinsulin; follicle stimulating hormone; calcitonin; luteinizing hormone; glucagon; clotting factors such as factor vmc, factor IX, tissue factor (TF), and von Willebrands factor; anti-clotting factors such as Protein C; atrial natriuretic factor; lung surfactant; a plasminogen activator, such as urokinase or human urine or tissue-type plasminogen activator (t-PA); bombesin; thrombin; hemopoietic growth factor; tumor necrosis factor-alpha and -beta; enkephalinase; RANTES (regulated on activation normally T-cell expressed and secreted); human macrophage inflammatory protein (MIP-I-alpha); a serum albumin, such as human serum albumin; Muellerian-inhibiting substance; relaxin A-chain; relaxin B-chain; prorelaxin; mouse gonadotropin-associated peptide; a microbial protein, such as beta-lactamase; DNase; 19E; a cytotoxic T-lymphocyte associated antigen (CTLA), such as CTLA-4; inhibin; activin; vascular endothelial growth factor (VEGF); receptors for hormones or growth factors; protein A or D; rheumatoid factors; a neurotrophic factor such as bone-derived neurotrophic factor (BDNF), neurotrophin-3, -4, -5, or -6 (NT-3, NT4, NT-5, or NT-6), or a nerve growth factor such as NGF-β; platelet-derived growth factor (PDGF); fibroblast growth factor such as aFGF and bFGF; fibroblast growth factor receptor 2 (FGFR2), epidermal growth factor (EGF); transforming growth factor (TGF) such as TGF-alpha and TGF-beta, including TGF-β1, TGF-β2, TGF-β3, TGF-β4, or TGF-β5; insulin-like growth factor-I and -2 (IGF-I and IGF-2); des(I-3)-IGF-I (brain IGF-I), insulin-like growth factor binding proteins, EpCAM, gD3, FLT3, PSMA, PSCA, MUC1, MUC16, STEAP, STEAP2, CEA, TENB2, EphA receptors, EphB receptors, folate receptor, FOLRI, mesothelin, cripto, alphavbeta6, integrins, VEGF, VEGFR, EGFR, transferrin receptor, IRTAI, IRTA2, IRTA3, IRTA4, IRTA5; CD proteins such as CD2, CD3, CD4, CD5, CD6, CD8, CDII, CD14, CD19, CD20, CD21, CD22, CD25, CD26, CD28, CD30, CD33, CD36, CD37, CD38, CD40, CD44, CD52, CD55, CD56, CD59, CD70, CD79, CD80, CD81, CD103, CD105, CD134, CD137, CD138, CD152, or an antibody which binds to one or more tumor-associated antigens or cell-surface receptors disclosed in US Publication No. 2008/0171040 or US Publication No. 2008/0305044 and incorporated in their entirety by reference; erythropoietin; osteoinductive factors; immunotoxins; a bone morphogenetic protein (BMP); an interferon, such as interferon-alpha, -beta, and -gamma; colony stimulating factors (CSFs), e.g., M-CSF, gM-CSF, and g-CSF; interleukins (ILs), e.g., IL-1 to IL-10; superoxide dismutase; T-cell receptors; surface membrane proteins; decay accelerating factor; viral antigen such as, for example, a portion of the HIV envelope; transport proteins; homing receptors; addressins; regulatory proteins; integrins, such as CDIIa, CDIIb, CDIIc, CD18, an ICAM, VLA-4 and VCAM; a tumor associated antigen such as AFP, ALK, B7H4, BAGE proteins, β-catenin, brc-abl, BRCA1, BORIS, CA9 (carbonic anhydrase IX), caspase-8, CD20, CD40, CD123, CDK4, CEA, CLEC12A, c-kit, cMET, CTLA4, cyclin-B1, CYP1B1, EGFR, EGFRVIII, endoglin, Epcam, EphA2, ErbB2/HER2, ErbB3/HER3, ErbB4/HER4, ETV6-AML, Fra-1, FOLR1, gAGE proteins (e.g., gAGE-1, -2), gD2, gD3, globoH, glypican-3, gM3, gp100, HER2, HLA/B-raf, HLA/EBNA1, HLA/k-ras, HLA/MAGE-A3, hTERT, IGF1R, LGR5, LMP2, MAGE proteins (e.g., MAGE-1, -2, -3, -4, -6, and -12), MART-1, mesothelin, mL-IAP, Muc1, Muc16 (CA-125), MET, MUM1, NA17, NGEP, NY-BR1, NY-BR62, NY-BR85, NY-ESO1, OX40, p15, p53, PAP, PAX3, PAX5, PCTA-1, PDGFR-α, PDGFR-β, PDGF-A, PDGF-B, PDGF-C, PDGF-D, PLAC1, PRLR, PRAME, PSCA, PSGR, PSMA (FOLH1), RAGE proteins, Ras, RGS5, Rho, SART-1, SART-3, STEAP1, STEAP2, STn, survivin, TAG-72, TGF-β, TMPRSS2, Tn, TNFRSF17, TRP-1, TRP-2, tyrosinase, and uroplakin-3, and fragments of any of the herein-listed polypeptides.

Exemplary antigens also include, but are not limited to, BCMA, SLAMF7, B7H4, gPNMB, UPK3A, and LGR5. Exemplary antigens also include, but are not limited to, MUC16, PSMA, STEAP2, and HER2.

In some embodiments, antigens also include, but are not limited to, hematologic targets, e.g., CD22, CD30, CD33, CD79a, and CD79b.

Some embodiments herein are target specific for therapeutic or diagnostic use. In one embodiment, binding agents are prepared to interact with and bind to antigens defined as tumor antigens, which include antigens specific for a type of tumor or antigens that are shared, overexpressed or modified on a particular type of tumor. Examples include: alpha-actinin-4 with lung cancer, ARTC1 with melanoma, BCR-ABL fusion protein with chronic myeloid leukemia, B-RAF, CLPP or Cdc27 with melanoma, CASP-8 with squamous cell carcinoma, and hsp70-2 with renal cell carcinoma as well as the following shared tumor-specific antigens, for example: BAGE-1, gAGE, gnTV, KK-LC-1, MAGE-A2, NA88-A, TRP2-INT2. In some embodiments, the antigen is PRLR or HER2. In some embodiments, the antibody binds STEAP2, MUC16, EGFR, EGFRVIII, FGR2, or PRLR.

In some embodiments, the antigens include HER2. In some embodiments, the antigens include STEAP2. In some embodiments, the antigens include MET. In some embodiments, the antigens include EGFRVIII. In some embodiments, the antigens include MUC16. In some embodiments, the antigens include PRLR. In some embodiments, the antigens include PSMA. In some embodiments, the antigens include FGFR2.

In some embodiments, the BA is an anti-HER2 antibody, an anti-STEAP2 antibody, an anti-MET antibody, an anti-EGFRVIII antibody, an anti-MUC16 antibody, an anti-PRLR antibody, an anti-PSMA antibody, or an anti-FGFR2 antibody, an anti-HER2/HER2 bispecific antibody, an anti-MET/MET bispecific antibody, or an anti-FOLR1 antibody, or an antigen-binding fragment thereof.

In some embodiments, the BA targets a cancer selected from the group consisting of breast cancer, ovarian cancer, prostate cancer, lung cancer, liver cancer, or brain cancer.

Anti-HER2 Antibodies Suitable for Protein-Drug Conjugates

In some embodiments, the antibody is an anti HER2 antibody. In some embodiments, the antibody is trastuzumab, pertuzumab (2C4) or margetuximab (MGAH22). In some embodiment, the antibody is trastuzumab. According to certain embodiments, protein-drug conjugates, e.g., ADCs, according to the disclosure comprise anti-HER2 antibody. In some embodiment, the anti-HER2 antibody may include those described in WO 2019/212965 A1.

In some embodiments, the antibody is an anti-HER2/HER2 bispecific antibody, which comprises a first antigen-binding domain (D1) which specifically binds a first epitope of human HER2 and a second antigen-binding domain (D2) which specifically binds a second epitope of human HER2.

In certain embodiments, D1 and D2 domains of an anti-HER2/HER2 bispecific antibody are non-competitive with one another. Non-competition between D1 and D2 for binding to HER2 means that, the respective monospecific antigen binding proteins from which D1 and D2 were derived do not compete with one another for binding to human HER2. Exemplary antigen-binding protein competition assays are known in the art.

In certain embodiments, D1 and D2 bind to different (e.g., non-overlapping, or partially overlapping) epitopes on HER2.

In one non-limiting embodiment, the present disclosure provides protein-drug conjugates comprising a bispecific antigen-binding molecule comprising:

a first antigen-binding domain (D1); and a second antigen-binding domain (D2);

wherein D1 specifically binds a first epitope of human HER2; and wherein D2 specifically binds a second epitope of human HER2.

Anti-HER2/HER2 bispecific antibodies may be constructed using the antigen-binding domains of two separate monospecific anti-HER2 antibodies. For example, a collection of monoclonal monospecific anti-HER2 antibodies may be produced using standard methods known in the art. The individual antibodies thus produced may be tested pairwise against one another for cross-competition to a HER2 protein. If two different anti-HER2 antibodies are able to bind to HER2 at the same time (i.e., do not compete with one another), then the antigen-binding domain from the first anti-HER2 antibody and the antigen-binding domain from the second, non-competitive anti-HER2 antibody can be engineered into a single anti-HER2/HER2 bispecific antibody in accordance with the present disclosure.

According to the present disclosure, a bispecific antigen-binding molecule can be a single multifunctional polypeptide, or it can be a multimeric complex of two or more polypeptides that are covalently or non-covalently associated with one another. As will be made evident by the present disclosure, any antigen binding construct which has the ability to simultaneously bind two separate, non-identical epitopes of the HER2 molecule is regarded as a bispecific antigen-binding molecule. Any of the bispecific antigen-binding molecules described herein, or variants thereof, may be constructed using standard molecular biological techniques (e.g., recombinant DNA and protein expression technology) as will be known to a person of ordinary skill in the art.

In another aspect, the disclosure provides a pharmaceutical composition comprising a recombinant human antibody or fragment thereof which specifically binds HER2 and a pharmaceutically acceptable carrier. In one non-limiting embodiment, the antibody may bind two separate epitopes on the HER2 protein, i.e., the antibody is a HER2/HER2 bispecific antibody. In a related aspect, the disclosure features a composition which is a combination of an anti-HER2/HER2 antibody and a second therapeutic agent. In one embodiment, the second therapeutic agent is any agent that is advantageously combined with an anti-HER2/HER2 antibody. Additional combination therapies and co-formulations involving the anti-HER2/HER2 bispecific antibodies of the present disclosure are disclosed elsewhere herein.

In another aspect, the disclosure provides therapeutic methods for targeting/killing tumor cells expressing HER2 using an anti-HER2/HER2 bispecific antibody of the disclosure, wherein the therapeutic methods comprise administering a therapeutically effective amount of a pharmaceutical composition comprising an anti-HER2/HER2 antibody of the disclosure to a subject in need thereof. In some cases, the anti-HER2/HER2 antibodies (or antigen-binding fragments thereof) can be used for treating breast cancer, or may be modified to be more cytotoxic by methods, including but not limited to, modified Fc domains to increase ADCC (see e.g., Shield et al. (2002) JBC 277:26733), radioimmunotherapy, antibody-drug conjugates, or other methods for increasing the efficiency of tumor ablation.

The present disclosure also includes the use of an anti-HER2 antibody of the disclosure in the manufacture of a medicament for the treatment of a disease or disorder (e.g., cancer) related to or caused by HER2-expressing cells. In one aspect, the disclosure relates to a compound comprising an anti-HER2 antibody or antigen-binding fragment, or a HER2/HER2 bispecific antibody, as disclosed herein, for use in medicine. In one aspect, the disclosure relates to a compound comprising an antibody-drug conjugate (ADC) as disclosed herein, for use in medicine.

In yet another aspect, the disclosure provides bispecific anti-HER2/HER2 antibodies for diagnostic applications, such as, e.g., imaging reagents.

Anti-STEAP2 Antibodies Suitable for Protein-Drug Conjugates

In some embodiments, the antibody is an anti-six-transmembrane epithelial antigen of prostate 2 (STEAP2), i.e., an anti-STEAP2 antibody. STEAP2, which works as a shuttle between the Golgi complex and the plasma membrane, is a metalloreductase which reduces iron and copper, facilitating their import into the cell. STEAP2 is mainly localized to epithelial cells of the prostate. STEAP2 is also expressed in normal heart, brain, pancreas, ovary, skeletal muscle, mammary gland, testis, uterus, kidney, lung, trachea, colon, and liver. STEAP2 is over-expressed in cancerous tissues, including prostate, bladder, cervix, lung, colon, kidney, breast, pancreatic, stomach, uterus, and ovarian tumors (Gomes, I. M. et al., 2012, Mol. Cancer Res. 10:573-587; Challita-Eid-P. M., et al., 2003, WO 03/087306; Emtage, P. C. R., 2005, WO 2005/079490).

In one aspect, suitable anti-STEAP antibodies are those disclosed in US2018/0104357. Exemplary anti-STEAP2 antibodies according to the present disclosure are listed in Tables 1 and 2 herein. Table 1 sets forth the amino acid sequence identifiers of the heavy chain variable regions (HCVRs) and light chain variable regions (LCVRs), as well as heavy chain complementarity determining regions (HCDR1, HCDR2 and HCDR3), and light chain complementarity determining regions (LCDR1, LCDR2 and LCDR3) of the exemplary anti-STEAP2 antibodies. Table 2 sets forth the sequence identifiers of the nucleic acid molecules encoding the HCVRs, LCVRs, HCDR1, HCDR2 HCDR3, LCDR1, LCDR2 and LCDR3 of the exemplary anti-STEAP2 antibodies.

The present disclosure provides antibodies, or antigen-binding fragments thereof, comprising an HCVR comprising an amino acid sequence selected from any of the HCVR amino acid sequences listed in Table 1, or a substantially similar sequence thereof having at least 90%, at least 95%, at least 98% or at least 99% sequence identity thereto.

The present disclosure also provides antibodies, or antigen-binding fragments thereof, comprising an LCVR comprising an amino acid sequence selected from any of the LCVR amino acid sequences listed in Table 1, or a substantially similar sequence thereof having at least 90%, at least 95%, at least 98% or at least 99% sequence identity thereto.

The present disclosure also provides antibodies, or antigen-binding fragments thereof, comprising an HCVR and an LCVR amino acid sequence pair (HCVR/LCVR) comprising any of the HCVR amino acid sequences listed in Table 1 paired with any of the LCVR amino acid sequences listed in Table 1. According to certain embodiments, the present disclosure provides antibodies, or antigen-binding fragments thereof, comprising an HCVR/LCVR amino acid sequence pair contained within any of the exemplary anti-STEAP2 antibodies listed in Table 1. In certain embodiments, the HCVR/LCVR amino acid sequence pair is selected from the group consisting of SEQ ID NOs: 250/258 (e.g., H2M11162N).

The present disclosure also provides antibodies, or antigen-binding fragments thereof, comprising a heavy chain CDR1 (HCDR1) comprising an amino acid sequence selected from any of the HCDR1 amino acid sequences listed in Table 1 or a substantially similar sequence thereof having at least 90%, at least 95%, at least 98% or at least 99% sequence identity.

The present disclosure also provides antibodies, or antigen-binding fragments thereof, comprising a heavy chain CDR2 (HCDR2) comprising an amino acid sequence selected from any of the HCDR2 amino acid sequences listed in Table 1 or a substantially similar sequence thereof having at least 90%, at least 95%, at least 98% or at least 99% sequence identity.

The present disclosure also provides antibodies, or antigen-binding fragments thereof, comprising a heavy chain CDR3 (HCDR3) comprising an amino acid sequence selected from any of the HCDR3 amino acid sequences listed in Table 1 or a substantially similar sequence thereof having at least 90%, at least 95%, at least 98% or at least 99% sequence identity.

The present disclosure also provides antibodies, or antigen-binding fragments thereof, comprising a light chain CDR1 (LCDR1) comprising an amino acid sequence selected from any of the LCDR1 amino acid sequences listed in Table 1 or a substantially similar sequence thereof having at least 90%, at least 95%, at least 98% or at least 99% sequence identity.

The present disclosure also provides antibodies, or antigen-binding fragments thereof, comprising a light chain CDR2 (LCDR2) comprising an amino acid sequence selected from any of the LCDR2 amino acid sequences listed in Table 1 or a substantially similar sequence thereof having at least 90%, at least 95%, at least 98% or at least 99% sequence identity.

The present disclosure also provides antibodies, or antigen-binding fragments thereof, comprising a light chain CDR3 (LCDR3) comprising an amino acid sequence selected from any of the LCDR3 amino acid sequences listed in Table 1 or a substantially similar sequence thereof having at least 90%, at least 95%, at least 98% or at least 99% sequence identity.

The present disclosure also provides antibodies, or antigen-binding fragments thereof, comprising an HCDR3 and an LCDR3 amino acid sequence pair (HCDR3/LCDR3) comprising any of the HCDR3 amino acid sequences listed in Table 1 paired with any of the LCDR3 amino acid sequences listed in Table 1. According to certain embodiments, the present disclosure provides antibodies, or antigen-binding fragments thereof, comprising an HCDR3/LCDR3 amino acid sequence pair contained within any of the exemplary anti-STEAP2 antibodies listed in Table 1. In certain embodiments, the HCDR3/LCDR3 amino acid sequence pair is selected from the group consisting of SEQ ID NOs: 256/264 (e.g., H2M11162N).

The present disclosure also provides antibodies, or antigen-binding fragments thereof, comprising a set of six CDRs (i.e., HCDR1-HCDR2-HCDR3-LCDR1-LCDR2-LCDR3) contained within any of the exemplary anti-STEAP2 antibodies listed in Table 1. In certain embodiments, the HCDR1-HCDR2-HCDR3-LCDR1-LCDR2-LCDR3 amino acid sequences set is selected from the group consisting of SEQ ID NOs: 252-254-256-260-262-264 (e.g., H2M11162N).

In a related embodiment, the present disclosure provides antibodies, or antigen-binding fragments thereof, comprising a set of six CDRs (i.e., HCDR1-HCDR2-HCDR3-LCDR1-LCDR2-LCDR3) contained within an HCVR/LCVR amino acid sequence pair as defined by any of the exemplary anti-STEAP2 antibodies listed in Table 1. For example, the present disclosure includes antibodies, or antigen-binding fragments thereof, comprising the HCDR1-HCDR2-HCDR3-LCDR1-LCDR2-LCDR3 amino acid sequences set contained within an HCVR/LCVR amino acid sequence pair selected from the group consisting of SEQ ID NOs: 250/258 (e.g., H2M11162N). Methods and techniques for identifying CDRs within HCVR and LCVR amino acid sequences are well known in the art and can be used to identify CDRs within the specified HCVR and/or LCVR amino acid sequences disclosed herein. Exemplary conventions that can be used to identify the boundaries of CDRs include, e.g., the Kabat definition, the Chothia definition, and the AbM definition. In general terms, the Kabat definition is based on sequence variability, the Chothia definition is based on the location of the structural loop regions, and the AbM definition is a compromise between the Kabat and Chothia approaches. See, e.g., Kabat, "Sequences of Proteins of Immunological Interest," National Institutes of Health, Bethesda, Md. (1991); Al-Lazikani et al., *J. Mol. Biol.* 273:927-948 (1997); and Martin et al., *Proc. Natl. Acad. Sci. USA* 86:9268-9272 (1989). Public databases are also available for identifying CDR sequences within an antibody.

The present disclosure also provides nucleic acid molecules encoding anti-STEAP2 antibodies or portions thereof. For example, the present disclosure provides nucleic acid molecules encoding any of the HCVR amino acid sequences listed in Table 1; in certain embodiments the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto.

The present disclosure also provides nucleic acid molecules encoding any of the LCVR amino acid sequences listed in Table 1; in certain embodiments the nucleic acid molecule comprises a polynucleotide sequence selected from any of the LCVR nucleic acid sequences listed in Table 2, or a substantially similar sequence thereof having at least 90%, at least 95%, at least 98% or at least 99% sequence identity thereto.

The present disclosure also provides nucleic acid molecules encoding any of the HCDR1 amino acid sequences listed in Table 1; in certain embodiments the nucleic acid molecule comprises a polynucleotide sequence selected from any of the HCDR1 nucleic acid sequences listed in Table 2, or a substantially similar sequence thereof having at least 90%, at least 95%, at least 98% or at least 99% sequence identity thereto.

The present disclosure also provides nucleic acid molecules encoding any of the HCDR2 amino acid sequences listed in Table 1; in certain embodiments the nucleic acid molecule comprises a polynucleotide sequence selected from any of the HCDR2 nucleic acid sequences listed in Table 2, or a substantially similar sequence thereof having at least 90%, at least 95%, at least 98% or at least 99% sequence identity thereto.

The present disclosure also provides nucleic acid molecules encoding any of the HCDR3 amino acid sequences listed in Table 1; in certain embodiments the nucleic acid molecule comprises a polynucleotide sequence selected from any of the HCDR3 nucleic acid sequences listed in Table 2, or a substantially similar sequence thereof having at least 90%, at least 95%, at least 98% or at least 99% sequence identity thereto.

The present disclosure also provides nucleic acid molecules encoding any of the LCDR1 amino acid sequences listed in Table 1; in certain embodiments the nucleic acid molecule comprises a polynucleotide sequence selected from any of the LCDR1 nucleic acid sequences listed in Table 2, or a substantially similar sequence thereof having at least 90%, at least 95%, at least 98% or at least 99% sequence identity thereto.

The present disclosure also provides nucleic acid molecules encoding any of the LCDR2 amino acid sequences listed in Table 1; in certain embodiments the nucleic acid molecule comprises a polynucleotide sequence selected from any of the LCDR2 nucleic acid sequences listed in Table 2, or a substantially similar sequence thereof having at least 90%, at least 95%, at least 98% or at least 99% sequence identity thereto.

The present disclosure also provides nucleic acid molecules encoding any of the LCDR3 amino acid sequences listed in Table 1; in certain embodiments the nucleic acid molecule comprises a polynucleotide sequence selected from any of the LCDR3 nucleic acid sequences listed in Table 2, or a substantially similar sequence thereof having at least 90%, at least 95%, at least 98% or at least 99% sequence identity thereto.

The present disclosure also provides nucleic acid molecules encoding an HCVR, wherein the HCVR comprises a set of three CDRs (i.e., HCDR1-HCDR2-HCDR3), wherein the HCDR1-HCDR2-HCDR3 amino acid sequence set is as defined by any of the exemplary anti-STEAP2 antibodies listed in Table 1.

The present disclosure also provides nucleic acid molecules encoding an LCVR, wherein the LCVR comprises a set of three CDRs (i.e., LCDR1-LCDR2-LCDR3), wherein the LCDR1-LCDR2-LCDR3 amino acid sequence set is as defined by any of the exemplary anti-STEAP2 antibodies listed in Table 1.

The present disclosure also provides nucleic acid molecules encoding both an HCVR and an LCVR, wherein the HCVR comprises an amino acid sequence of any of the HCVR amino acid sequences listed in Table 1, and wherein the LCVR comprises an amino acid sequence of any of the LCVR amino acid sequences listed in Table 1. In certain embodiments, the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto, and a polynucleotide sequence selected from any of the LCVR nucleic acid sequences listed in Table 2, or a substantially similar sequence thereof having at least 90%, at least 95%, at least 98% or at least 99% sequence identity thereto. In certain embodiments according to this aspect of the disclosure, the nucleic acid molecule encodes an HCVR and LCVR, wherein the HCVR and LCVR are both derived from the same anti-STEAP2 antibody listed in Table 1.

The present disclosure also provides recombinant expression vectors capable of expressing a polypeptide comprising a heavy or light chain variable region of an anti-STEAP2 antibody. For example, the present disclosure includes recombinant expression vectors comprising any of the nucleic acid molecules mentioned above, i.e., nucleic acid molecules encoding any of the HCVR, LCVR, and/or CDR sequences as set forth in Table 1. Also included within the scope of the present disclosure are host cells into which such vectors have been introduced, as well as methods of producing the antibodies or portions thereof by culturing the host cells under conditions permitting production of the antibodies or antibody fragments, and recovering the antibodies and antibody fragments so produced.

The present disclosure includes anti-STEAP2 antibodies having a modified glycosylation pattern. In some embodiments, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

In another aspect, the disclosure provides a pharmaceutical composition comprising a recombinant human antibody or fragment thereof which specifically binds STEAP2 and a pharmaceutically acceptable carrier. In a related aspect, the disclosure features a composition which is a combination of an anti-STEAP2 antibody and a second therapeutic agent. In one embodiment, the second therapeutic agent is any agent that is advantageously combined with an anti-STEAP2 antibody. Additional combination therapies and co-formulations involving the anti-STEAP2 antibodies of the present disclosure are disclosed elsewhere herein.

In another aspect, the disclosure provides therapeutic methods for targeting/killing tumor cells expressing STEAP2 using an anti-STEAP2 antibody of the disclosure, wherein the therapeutic methods comprise administering a therapeutically effective amount of a pharmaceutical composition comprising an anti-STEAP2 antibody of the disclosure to a subject in need thereof. In some cases, the anti-STEAP2 antibodies (or antigen-binding fragments thereof) can be used for treating prostate cancer, or may be modified to be more cytotoxic by methods, including but not limited to, modified Fc domains to increase ADCC (see e.g., Shield et al. (2002) JBC 277:26733), radioimmunotherapy, antibody-drug conjugates, or other methods for increasing the efficiency of tumor ablation.

The present disclosure also includes the use of an anti-STEAP2 antibody of the disclosure in the manufacture of a medicament for the treatment of a disease or disorder (e.g., cancer) related to or caused by STEAP2-expressing cells. In one aspect, the disclosure relates to a compound comprising an anti-STEAP2 antibody or antigen-binding fragment, or a STEAP2×CD3 bispecific antibody, as disclosed herein, for use in medicine. In one aspect, the disclosure relates to a compound comprising an antibody-drug conjugate (ADC) as disclosed herein, for use in medicine.

In yet another aspect, the disclosure provides monospecific anti-STEAP2 antibodies for diagnostic applications, such as, e.g., imaging reagents.

In yet another aspect, the disclosure provides therapeutic methods for stimulating T cell activation using an anti-CD3 antibody or antigen-binding portion of an antibody of the disclosure, wherein the therapeutic methods comprise administering a therapeutically effective amount of a pharmaceutical composition comprising an antibody In another aspect, the present disclosure provides an isolated antibody or antigen-binding fragment thereof that binds STEAP2-expressing C4-2 cells with an EC50 of less than 50 nM as measured by FACS analysis. In another aspect, the present disclosure provides an isolated antibody or antigen-binding fragment thereof that binds and is internalized by STEAP2-expressing C4-2 cells.

The disclosure further provides an antibody or antigen-binding fragment that competes for binding to human STEAP2 with a reference antibody comprising an HCVR/LCVR amino acid sequence pair as set forth in Table 1. In another aspect, the disclosure provides an antibody or antigen-binding fragment that competes for binding to human STEAP2 with a reference antibody comprising an HCVR/LCVR amino acid sequence pair selected from the group consisting of SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

The disclosure furthermore provides an antibody or antigen-binding fragment, wherein the antibody or antigen-binding fragment thereof binds to the same epitope on human STEAP2 as a reference antibody comprising an HCVR/LCVR amino acid sequence pair as set forth in Table 1. In another aspect, the antibody or antigen-binding fragment binds to the same epitope on human STEAP2 as a reference antibody comprising an HCVR/LCVR amino acid sequence pair selected from the group consisting of SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

The disclosure further provides an isolated antibody or antigen-binding fragment thereof that binds human STEAP2, wherein the antibody or antigen-binding fragment comprises: the complementarity determining regions (CDRs) of a heavy chain variable region (HCVR) having an amino acid sequence as set forth in Table 1; and the CDRs of a light chain variable region (LCVR) having an amino acid sequence as set forth in Table 1. In another aspect, the isolated antibody or antigen-binding fragment comprises the heavy and light chain CDRs of a HCVR/LCVR amino acid sequence pair selected from the group consisting of: SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386. In yet another aspect, the isolated antibody or antigen-binding fragment comprises HCDR1-HCDR2-HCDR3-LCDR1-LCDR2-LCDR3 domains, respectively, selected from the group consisting of: SEQ ID NOs:4-6-8-12-14-16; 20-22-24-28-30-32; 36-38-40-44-46-48; 52-54-56-60-62-64; 68-70-72-60-62-64; 76-78-80-60-62-64; 84-86-88-60-62-64; 92-94-96-60-62-64; 100-102-104-60-62-64; 108-110-112-116-118-120; 124-126-128-132-134-136; 140-142-144-148-150-152; 156-158-160-164-166-168; 172-174-176-180-182-184; 188-190-192-196-198-200; 204-206-208-212-214-216; 220-222-224-228-230-232; 236-238-240-244-246-248; 252-254-256-260-262-264; 268-270-272-276-278-280; 284-286-288-292-294-296; 300-302-304-308-310-312; 316-318-320-324-326-328; 332-334-336-340-342-344; 348-350-352-356-358-360; 364-366-368-372-374-376; and 380-382-384-388-390-392.

In another aspect, the disclosure provides an isolated antibody or antigen-binding fragment thereof that binds human STEAP2, wherein the antibody or antigen-binding fragment comprises: (a) a heavy chain variable region (HCVR) having an amino acid sequence selected from the group consisting of SEQ ID NOs: 2, 18, 34, 50, 66, 74, 82, 90, 98, 106, 122, 138, 154, 170, 186, 202, 218, 234, 250, 266, 282, 298, 314, 330, 346, 362, and 378; and (b) a light chain variable region (LCVR) having an amino acid sequence selected from the group consisting of SEQ ID NOs: 10; 26; 42; 58 114; 130; 146; 162; 178; 194; 210; 226, 242; 258; 274; 290; 306; 322; 338; 354; 370; and 386. In a further aspect, the isolated antibody or antigen-binding fragment comprises a HCVR/LCVR amino acid sequence pair selected from the group consisting of: SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

According to another aspect, the present disclosure provides antibody-drug conjugates comprising an anti-STEAP2 antibody or antigen-binding fragment thereof as described above and a therapeutic agent (e.g., an anti-tumor agent, e.g., a camptothecin analog, e.g., Dxd). In some embodiments, the antibody or antigen-binding fragment and the anti-tumor agent are covalently attached via a linker, as discussed above. In various embodiments, the anti-STEAP2 antibody or antigen-binding fragment can be any of the anti-STEAP 2 antibodies or fragments described herein.

Heavy and Light Chain Variable Region Amino Acid and Nucleic Acid Sequences of Anti-STEAP2 Antibodies Table 1 sets forth the amino acid sequence identifiers of the heavy and light chain variable regions and CDRs of selected anti-STEAP2 antibodies according to the disclosure. The corresponding nucleic acid sequence identifiers are set forth in Table 2.

TABLE 1

Amino Acid Sequence Identifiers of anti-STEAP2 antibodies

| Antibody | SEQ ID NOs: | | | | | | | |
|---|---|---|---|---|---|---|---|---|
| Designation | HCVR | HCDR1 | HCDR2 | HCDR3 | LCVR | LCDR1 | LCDR2 | LCDR3 |
| H1H11243N | 2 | 4 | 6 | 8 | 10 | 12 | 14 | 16 |
| H1H11878P | 18 | 20 | 22 | 24 | 26 | 28 | 30 | 32 |
| H1H11880P | 34 | 36 | 38 | 40 | 42 | 44 | 46 | 48 |
| H1H11888P2 | 50 | 52 | 54 | 56 | 58 | 60 | 62 | 64 |
| H1H11892P2 | 66 | 68 | 70 | 72 | 58 | 60 | 62 | 64 |
| H1H11893P2 | 74 | 76 | 78 | 80 | 58 | 60 | 62 | 64 |
| H1H11894P2 | 82 | 84 | 86 | 88 | 58 | 60 | 62 | 64 |
| H1H11895P2 | 90 | 92 | 94 | 96 | 58 | 60 | 62 | 64 |
| H1H11896P2 | 98 | 100 | 102 | 104 | 58 | 60 | 62 | 64 |
| H1H11897P2 | 106 | 108 | 110 | 112 | 114 | 116 | 118 | 120 |
| H1H7968P | 122 | 124 | 126 | 128 | 130 | 132 | 134 | 136 |
| H1H7969P | 138 | 140 | 142 | 144 | 146 | 148 | 150 | 152 |
| H1H7970P | 154 | 156 | 158 | 160 | 162 | 164 | 166 | 168 |
| H1H7971P | 170 | 172 | 174 | 176 | 178 | 180 | 182 | 184 |

TABLE 1-continued

Amino Acid Sequence Identifiers of anti-STEAP2 antibodies

| Antibody Designation | SEQ ID NOs: HCVR | HCDR1 | HCDR2 | HCDR3 | LCVR | LCDR1 | LCDR2 | LCDR3 |
|---|---|---|---|---|---|---|---|---|
| H1H7972P | 186 | 188 | 190 | 192 | 194 | 196 | 198 | 200 |
| H1M7804N | 202 | 204 | 206 | 208 | 210 | 212 | 214 | 216 |
| H1M7814N | 218 | 220 | 222 | 224 | 226 | 228 | 230 | 232 |
| H1M7832N | 234 | 236 | 238 | 240 | 242 | 244 | 246 | 248 |
| H2M11162N | 250 | 252 | 254 | 256 | 258 | 260 | 262 | 264 |
| H2M11163N | 266 | 268 | 270 | 272 | 274 | 276 | 278 | 280 |
| H2M11164N | 282 | 284 | 286 | 288 | 290 | 292 | 294 | 296 |
| H2M7806N | 298 | 300 | 302 | 304 | 306 | 308 | 310 | 312 |
| H2M7807N | 314 | 316 | 318 | 320 | 322 | 324 | 326 | 328 |
| H2M7809N | 330 | 332 | 334 | 336 | 338 | 340 | 342 | 344 |
| H2M7810N | 346 | 348 | 350 | 352 | 354 | 356 | 358 | 360 |
| H2M7811N | 362 | 364 | 366 | 368 | 370 | 372 | 374 | 376 |
| H2M7812N | 378 | 380 | 382 | 384 | 386 | 388 | 390 | 392 |

TABLE 2

Nucleic Acid Sequence Identifiers of anti-STEAP2 antibodies

| Antibody Designation | SEQ ID NOs: HCVR | HCDR1 | HCDR2 | HCDR3 | LCVR | LCDR1 | LCDR2 | LCDR3 |
|---|---|---|---|---|---|---|---|---|
| H1H11243N | 1 | 3 | 5 | 7 | 9 | 11 | 13 | 15 |
| H1H11878P | 17 | 19 | 21 | 23 | 25 | 27 | 29 | 31 |
| H1H11880P | 33 | 35 | 37 | 39 | 41 | 43 | 45 | 47 |
| H1H11888P2 | 49 | 51 | 53 | 55 | 57 | 59 | 61 | 63 |
| H1H11892P2 | 65 | 67 | 69 | 71 | 57 | 59 | 61 | 63 |
| H1H11893P2 | 73 | 75 | 77 | 79 | 57 | 59 | 61 | 63 |
| H1H11894P2 | 81 | 83 | 85 | 87 | 57 | 59 | 61 | 63 |
| H1H11895P2 | 89 | 91 | 93 | 95 | 57 | 59 | 61 | 63 |
| H1H11896P2 | 97 | 99 | 101 | 103 | 57 | 59 | 61 | 63 |
| H1H11897P2 | 105 | 107 | 109 | 111 | 113 | 115 | 117 | 119 |
| H1H7968P | 121 | 123 | 125 | 127 | 129 | 131 | 133 | 135 |
| H1H7969P | 137 | 139 | 141 | 143 | 145 | 147 | 149 | 151 |
| H1H7970P | 153 | 155 | 157 | 159 | 161 | 163 | 165 | 167 |
| H1H7971P | 169 | 171 | 173 | 175 | 177 | 179 | 181 | 183 |
| H1H7972P | 185 | 187 | 189 | 191 | 193 | 195 | 197 | 199 |
| H1M7804N | 201 | 203 | 205 | 207 | 209 | 211 | 213 | 215 |
| H1M7814N | 217 | 219 | 221 | 223 | 225 | 227 | 229 | 231 |
| H1M7832N | 233 | 235 | 237 | 239 | 241 | 243 | 245 | 247 |
| H2M11162N | 249 | 251 | 253 | 255 | 257 | 259 | 261 | 263 |
| H2M11163N | 265 | 267 | 269 | 271 | 273 | 275 | 277 | 279 |
| H2M11164N | 281 | 283 | 285 | 287 | 289 | 291 | 293 | 295 |
| H2M7806N | 297 | 299 | 301 | 303 | 305 | 307 | 309 | 311 |
| H2M7807N | 313 | 315 | 317 | 319 | 321 | 323 | 325 | 327 |
| H2M7809N | 329 | 331 | 333 | 335 | 337 | 339 | 341 | 343 |
| H2M7810N | 345 | 347 | 349 | 351 | 353 | 355 | 357 | 359 |
| H2M7811N | 361 | 363 | 365 | 367 | 369 | 371 | 373 | 375 |

Anti-MET Antibodies Suitable for Protein-Drug Conjugates

In some embodiments, the antibody is an anti MET antibody. According to certain embodiments, protein-drug conjugates, e.g., ADCs, according to the disclosure comprise anti-MET antibody. In some embodiment, the anti-MET antibody may include those described in US 2018/0134794.

In some embodiments, the antibody is an anti-MET/MET bispecific antibody, which comprises a first antigen-binding domain (D1) which specifically binds a first epitope of human MET and a second antigen-binding domain (D2) which specifically binds a second epitope of human MET. In some embodiment, the anti-MET/MET bispecific antibody may include those described in US 2018/0134794.

In certain embodiments, D1 and D2 domains of an anti-MET/MET bispecific antibody are non-competitive with one another. Non-competition between D1 and D2 for binding to MET means that, the respective monospecific antigen binding proteins from which D1 and D2 were derived do not compete with one another for binding to human MET. Exemplary antigen-binding protein competition assays are known in the art.

In certain embodiments, D1 and D2 bind to different (e.g., non-overlapping, or partially overlapping) epitopes on MET.

In one non-limiting embodiment, the present disclosure provides protein-drug conjugates comprising a bispecific antigen-binding molecule comprising:

a first antigen-binding domain (D1); and a second antigen-binding domain (D2);

wherein D1 specifically binds a first epitope of human MET; and wherein D2 specifically binds a second epitope of human MET.

Anti-MET/MET bispecific antibodies may be constructed using the antigen-binding domains of two separate mono-specific anti-MET antibodies. For example, a collection of monoclonal monospecific anti-MET antibodies may be produced using standard methods known in the art. The individual antibodies thus produced may be tested pairwise against one another for cross-competition to a MET protein. If two different anti-MET antibodies are able to bind to MET at the same time (i.e., do not compete with one another), then the antigen-binding domain from the first anti-MET antibody and the antigen-binding domain from the second, non-competitive anti-MET antibody can be engineered into a single anti-MET/MET bispecific antibody in accordance with the present disclosure.

According to the present disclosure, a bispecific antigen-binding molecule can be a single multifunctional polypeptide, or it can be a multimeric complex of two or more polypeptides that are covalently or non-covalently associated with one another. As will be made evident by the present disclosure, any antigen binding construct which has the ability to simultaneously bind two separate, non-identical epitopes of the MET molecule is regarded as a bispecific antigen-binding molecule. Any of the bispecific antigen-binding molecules described herein, or variants thereof, may be constructed using standard molecular biological techniques (e.g., recombinant DNA and protein expression technology) as will be known to a person of ordinary skill in the art.

The bispecific antigen-binding molecules, which comprise a first antigen-binding domain (D1) which specifically binds a first epitope of human MET and a second antigen-binding domain (D2) which specifically binds a second epitope of human MET, may be referred to herein as "MET/MET bispecific antibodies," "MET×MET bispecific antibodies," "MET/MET," "MET×MET" or other related terminology. In some embodiments, the first epitope of human MET comprises amino acids 192-204 of SEQ ID NO:2109. In some embodiments, the second epitope of human MET comprises amino acids 305-315 and 421-455 of SEQ ID NO:2109. In some embodiments, the first epitope of human MET comprises amino acids 192-204 of SEQ ID NO:2109; and the second epitope of human MET comprises amino acids 305-315 and 421-455 of SEQ ID NO:2109.

Exemplary antigen-binding domains (D1 and D2) that can be included in the MET×MET bispecific antigen-binding molecules provided herein include antigen-binding domains derived from any of the anti-MET antibodies disclosed herein. For example, the present disclosure includes MET×MET bispecific antigen-binding molecules comprising a D1 or D2 antigen-binding domain comprising an HCVR comprising an amino acid sequence selected from any of the HCVR amino acid sequences listed in Table 3, or a substantially similar sequence thereof having at least 90%, at least 95%, at least 98% or at least 99% sequence identity thereto.

Also provided herein are MET×MET bispecific antigen-binding molecules comprising a D1 or D2 antigen-binding domain comprising an LCVR comprising an amino acid sequence selected from any of the LCVR amino acid sequences listed in Table 3, or a substantially similar sequence thereof having at least 90%, at least 95%, at least 98% or at least 99% sequence identity thereto.

Provided herein are MET×MET bispecific antigen-binding molecules comprising a D1 or D2 antigen-binding domain comprising an HCVR and an LCVR amino acid sequence pair (HCVR/LCVR) comprising any of the HCVR amino acid sequences listed in Table 3 paired with any of the LCVR amino acid sequences listed in Table 3. According to certain embodiments, the present invention provides MET×MET bispecific antigen-binding molecules comprising a D1 or D2 antigen-binding domain comprising an HCVR/LCVR amino acid sequence pair contained within any of the exemplary anti-MET antibodies listed in Table 3.

Also provided herein are MET×MET bispecific antigen-binding molecules comprising a D1 or D2 antigen-binding domain comprising a heavy chain CDR1 (HCDR1) comprising an amino acid sequence selected from any of the HCDR1 amino acid sequences listed in Table 3 or a substantially similar sequence thereof having at least 90%, at least 95%, at least 98% or at least 99% sequence identity.

Also provided are MET×MET bispecific antigen-binding molecules comprising a D1 or D2 antigen-binding domain comprising a heavy chain CDR2 (HCDR2) comprising an amino acid sequence selected from any of the HCDR2 amino acid sequences listed in Table 3 or a substantially similar sequence thereof having at least 90%, at least 95%, at least 98% or at least 99% sequence identity.

Also provided are MET×MET bispecific antigen-binding molecules comprising a D1 or D2 antigen-binding domain comprising a heavy chain CDR3 (HCDR3) comprising an amino acid sequence selected from any of the HCDR3 amino acid sequences listed in Table 3 or a substantially similar sequence thereof having at least 90%, at least 95%, at least 98% or at least 99% sequence identity.

Also provided are MET×MET bispecific antigen-binding molecules comprising a D1 or D2 antigen-binding domain comprising a light chain CDR1 (LCDR1) comprising an amino acid sequence selected from any of the LCDR1 amino acid sequences listed in Table 3 or a substantially similar sequence thereof having at least 90%, at least 95%, at least 98% or at least 99% sequence identity.

Also provided are MET×MET bispecific antigen-binding molecules comprising a D1 or D2 antigen-binding domain comprising a light chain CDR2 (LCDR2) comprising an amino acid sequence selected from any of the LCDR2 amino acid sequences listed in Table 3 or a substantially similar sequence thereof having at least 90%, at least 95%, at least 98% or at least 99% sequence identity.

Also provided are MET×MET bispecific antigen-binding molecules comprising a D1 or D2 antigen-binding domain comprising a light chain CDR3 (LCDR3) comprising an amino acid sequence selected from any of the LCDR3 amino acid sequences listed in Table 3 or a substantially similar sequence thereof having at least 90%, at least 95%, at least 98% or at least 99% sequence identity.

Also provided are MET×MET bispecific antigen-binding molecules comprising a D1 or D2 antigen-binding domain comprising an HCDR3 and an LCDR3 amino acid sequence pair (HCDR3/LCDR3) comprising any of the HCDR3 amino acid sequences listed in Table 3 paired with any of the LCDR3 amino acid sequences listed in Table 3. According to certain embodiments, the present disclosure provides antibodies, or antigen-binding fragments thereof, comprising an HCDR3/LCDR3 amino acid sequence pair contained within any of the exemplary anti-MET antibodies listed in Table 3.

Also provided are MET×MET bispecific antigen-binding molecules comprising a D1 or D2 antigen-binding domain comprising a set of six CDRs (i.e., HCDR1-HCDR2-HCDR3-LCDR1-LCDR2-LCDR3) contained within any of the exemplary anti-MET antibodies listed in Table 3.

In a related embodiment, the present disclosure provides MET×MET bispecific antigen-binding molecules comprising a D1 or D2 antigen-binding domain comprising a set of six CDRs (i.e., HCDR1-HCDR2-HCDR3-LCDR1-LCDR2-

LCDR3) contained within an HCVR/LCVR amino acid sequence pair as defined by any of the exemplary anti-MET antibodies listed in Table 3.

The MET×MET bispecific antigen-binding molecules provided herein may comprise a D1 antigen-binding domain derived from any of the anti-MET antibodies of Table 3, and a D2 antigen-binding domain derived from any other anti-MET antibody of Table 3. Non-limiting examples of MET×MET bispecific antibodies of the present disclosure are depicted in FIG. 10. FIG. 10 is a matrix illustrating the components of 272 exemplary MET×MET bispecific antibodies. Each numbered cell of the matrix (numbered 1 through 272) identifies a unique bispecific antibody comprising a "D1" antigen binding domain and a "D2" antigen binding domain, wherein the D1 antigen binding domain comprises the immunoglobulin variable domain (HCVR/LCVR amino acid sequence pair) or CDRs from the corresponding anti-MET antibody listed along the Y-axis, and wherein the D2 antigen binding domain comprises the immunoglobulin variable domain (HCVR/LCVR amino acid sequence pair) or CDRs from the corresponding anti-MET antibody listed along the X-axis. Thus, for example, the MET×MET bispecific antigen-binding molecule "number 10" shown in the matrix comprises a D1 antigen-binding domain comprising an HCVR/LCVR pair, or 6-CDR set, from the exemplary anti-MET antibody H4H13290P2, and a D2 antigen-binding domain comprising an HCVR/LCVR pair, or 6-CDR set, from the exemplary anti-MET antibody H4H13321P2.

As a non-limiting illustrative example, the present disclosure includes MET×MET bispecific antigen binding molecules comprising a D1 antigen-binding domain and a D2 antigen-binding domain, wherein the D1 antigen binding domain comprises an HCVR/LCVR amino acid sequence pair of SEQ ID NOs: 2012/2092, or a set of heavy and light chain CDRs (HCDR1-HCDR2-HCDR3-LCDR1-LCDR2-LCDR3) comprising SEQ ID NOs: 2014-2016-2018-2094-2096-2098, and wherein the D2 antigen-binding domain comprises an HCVR/LCVR amino acid sequence pair of SEQ ID NOs: 2036/2092, or a set of heavy and light chain CDRs (HCDR1-HCDR2-HCDR3-LCDR1-LCDR2-LCDR3) comprising SEQ ID NOs: 2038-2040-2042-2094-2096-2098. An exemplary MET×MET bispecific antibody having these sequence characteristics is the bispecific antibody designated H4H14639D, also referred to as bispecific antibody No. 2076, which comprises a D1 derived from H4H13306P2 and a D2 derived from H4H13312P2.

Heavy and Light Chain Variable Region Amino Acid and Nucleic Acid Sequences for Anti-MET and MET/MET Antibodies Table 3 sets forth the amino acid sequence identifiers of the heavy and light chain variable regions and CDRs of selected anti-MET antibodies described herein. (As noted above, all anti-MET antibodies of the present disclosure possess the same light chain variable region, and thus the same light chain CDR sequences as well). The corresponding nucleic acid sequence identifiers are set forth in Table 4.

TABLE 3

| Amino Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H4H13290P2 | 1956 | 1958 | 1960 | 1962 | 2092 | 2094 | 2096 | 2098 |
| H4H13291P2 | 1964 | 1966 | 1968 | 1970 | 2092 | 2094 | 2096 | 2098 |
| H4H13295P2 | 1972 | 1974 | 1976 | 1978 | 2092 | 2094 | 2096 | 2098 |
| H4H13299P2 | 1980 | 1982 | 1984 | 1986 | 2092 | 2094 | 2096 | 2098 |
| H4H13300P2 | 1988 | 1990 | 1992 | 1994 | 2092 | 2094 | 2096 | 2098 |
| H4H13301P2 | 1996 | 1998 | 2000 | 2002 | 2092 | 2094 | 2096 | 2098 |
| H4H13302P2 | 2004 | 2006 | 2008 | 2010 | 2092 | 2094 | 2096 | 2098 |
| H4H13306P2 | 2012 | 2014 | 2016 | 2018 | 2092 | 2094 | 2096 | 2098 |
| H4H13309P2 | 2020 | 2022 | 2024 | 2026 | 2092 | 2094 | 2096 | 2098 |
| H4H13311P2 | 2028 | 2030 | 2032 | 2034 | 2092 | 2094 | 2096 | 2098 |
| H4H13312P2 | 2036 | 2038 | 2040 | 2042 | 2092 | 2094 | 2096 | 2098 |
| H4H13313P2 | 2044 | 2046 | 2048 | 2050 | 2092 | 2094 | 2096 | 2098 |
| H4H13316P2 | 2052 | 2054 | 2056 | 2058 | 2092 | 2094 | 2096 | 2098 |
| H4H13318P2 | 2060 | 2062 | 2064 | 2066 | 2092 | 2094 | 2096 | 2098 |
| H4H13319P2 | 2068 | 2070 | 2072 | 2074 | 2092 | 2094 | 2096 | 2098 |
| H4H13325P2 | 2076 | 2078 | 2080 | 2082 | 2092 | 2094 | 2096 | 2098 |
| H4H13331P2 | 2084 | 2086 | 2088 | 2090 | 2092 | 2094 | 2096 | 2098 |

TABLE 4

| Nucleic Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H4H13290P2 | 1955 | 1957 | 1959 | 1961 | 2091 | 2093 | 2095 | 2097 |
| H4H13291P2 | 1963 | 1965 | 1967 | 1969 | 2091 | 2093 | 2095 | 2097 |
| H4H13295P2 | 1971 | 1973 | 1975 | 1977 | 2091 | 2093 | 2095 | 2097 |
| H4H13299P2 | 1979 | 1981 | 1983 | 1985 | 2091 | 2093 | 2095 | 2097 |
| H4H13300P2 | 1987 | 1989 | 1991 | 1993 | 2091 | 2093 | 2095 | 2097 |
| H4H13301P2 | 1995 | 1997 | 1999 | 2001 | 2091 | 2093 | 2095 | 2097 |

TABLE 4-continued

| Nucleic Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H4H13302P2 | 2003 | 2005 | 2007 | 2009 | 2091 | 2093 | 2095 | 2097 |
| H4H13306P2 | 2011 | 2013 | 2015 | 2017 | 2091 | 2093 | 2095 | 2097 |
| H4H13309P2 | 2019 | 2021 | 2023 | 2025 | 2091 | 2093 | 2095 | 2097 |
| H4H13311P2 | 2027 | 2029 | 2031 | 2033 | 2091 | 2093 | 2095 | 2097 |
| H4H13312P2 | 2035 | 2037 | 2039 | 2041 | 2091 | 2093 | 2095 | 2097 |
| H4H13313P2 | 2043 | 2045 | 2047 | 2049 | 2091 | 2093 | 2095 | 2097 |
| H4H13316P2 | 2051 | 2053 | 2055 | 2057 | 2091 | 2093 | 2095 | 2097 |
| H4H13318P2 | 2059 | 2061 | 2063 | 2065 | 2091 | 2093 | 2095 | 2097 |
| H4H13319P2 | 2067 | 2069 | 2071 | 2073 | 2091 | 2093 | 2095 | 2097 |
| H4H13325P2 | 2075 | 2077 | 2079 | 2081 | 2091 | 2093 | 2095 | 2097 |
| H4H13331P2 | 2083 | 2085 | 2087 | 2089 | 2091 | 2093 | 2095 | 2097 |

Antibodies are typically referred to herein according to the following nomenclature: Fc prefix (e.g. "H4H"), followed by a numerical identifier (e.g. "13290," "13291," "13295," etc.), followed by a "P2" suffix, as shown in Tables 3 and 4. Thus, according to this nomenclature, an antibody may be referred to herein as, e.g., "H4H13290P2," "H4H13291P2," "H4H13295P2," etc. The prefix on the antibody designations used herein indicate the particular Fc region isotype of the antibody. In particular, an "H4H" antibody has a human IgG4 Fc (all variable regions are fully human as denoted by the first 'H' in the antibody designation). As will be appreciated by a person of ordinary skill in the art, an antibody having a particular Fc isotype can be converted to an antibody with a different Fc isotype (e.g., an antibody with a mouse IgG4 Fc can be converted to an antibody with a human IgG1, etc.), but in any event, the variable domains (including the CDRs)—which are indicated by the numerical identifiers shown in Tables 3 and 4—will remain the same, and the binding properties are expected to be identical or substantially similar regardless of the nature of the Fc domain.

Antibody Conjugation

Techniques and linkers for conjugating to residues of an antibody or antigen binding fragment are known in the art. Exemplary amino acid attachments that can be used in the context of this aspect, e.g., lysine (see, e.g., U.S. Pat. No. 5,208,020; US 2010/0129314; Hollander et al., *Bioconjugate Chem.*, 2008, 19:358-361; WO 2005/089808; U.S. Pat. No. 5,714,586; US 2013/0101546; and US 2012/0585592), cysteine (see, e.g., US 2007/0258987; WO 2013/055993; WO 2013/055990; WO 2013/053873; WO 2013/053872; WO 2011/130598; US 2013/0101546; and U.S. Pat. No. 7,750,116), selenoysteine (see, e.g., WO 2008/122039; and Hofer et al., *Proc. Natl. Acad. Sci., USA,* 2008, 105:12451-12456), formyl glycine (see, e.g., Carrico et al., *Nat. Chem. Biol.,* 2007, 3:321-322; Agarwal et al., *Proc. Natl. Acad. Sci., USA,* 2013, 110:46-51, and Rabuka et al., *Nat. Protocols,* 2012, 10:1052-1067), non-natural amino acids (see, e.g., WO 2013/068874, and WO 2012/166559), and acidic amino acids (see, e.g., WO 2012/05982). Lysine conjugation can also proceed through NHS (N-hydroxy succinimide). Linkers can also be conjugated to cysteine residues, including cysteine residues of a cleaved interchain disulfide bond, by forming a carbon bridge between thiols (see, e.g., U.S. Pat. Nos. 9,951,141, and 9,950,076). Linkers can also be conjugated to an antigen-binding protein via attachment to carbohydrates (see, e.g., US 2008/0305497, WO 2014/065661, and Ryan et al., *Food & Agriculture Immunol.,* 2001, 13:127-130) and disulfide linkers (see, e.g., WO 2013/085925, WO 2010/010324, WO 2011/018611, and Shaunak et al., *Nat. Chem. Biol.,* 2006, 2:312-313). Site specific conjugation techniques can also be employed to direct conjugation to particular residues of the antibody or antigen binding protein (see, e.g., Schumacher et al. *J Clin Immunol* (2016) 36 (Suppl 1): 100). In specific embodiments discussed in more detail below, Site specific conjugation techniques, include glutamine conjugation via transglutaminase (see e.g., Schibli, Angew Chemie Inter Ed. 2010, 49, 9995).

Payloads according to the disclosure linked through lysine and/or cysteine, e.g., via a maleimide or amide conjugation, are included within the scope of the present disclosure.

In some embodiments, the protein-drug conjugates of the present disclosure are produced according to a two-step process, where Step 1 is lysine-based linker conjugation, e.g., with an NHS-ester linker, and Step 2 is a payload conjugation reaction (e.g., a 1,3-cycloaddition reaction).

In some embodiments, the protein-drug conjugates of the present disclosure are produced according to a two-step process, where Step 1 is cysteine-based linker conjugation, e.g., with a maleimide linker, and Step 2 is a payload conjugation reaction (e.g., a 1,3-cycloaddition reaction).

In some embodiments, the protein-drug conjugates of the present disclosure are produced according to a two-step process, where Step 1 is transglutaminase-mediated site specific conjugation and Step 2 is a payload conjugation reaction (e.g., a 1,3-cycloaddition reaction).

Step 1: Transglutaminase Mediated Site Specific Conjugation

In some embodiments, proteins (e.g., antibodies) may be modified in accordance with known methods to provide glutaminyl modified proteins. Techniques for conjugating antibodies and primary amine compounds are known in the art. Site specific conjugation techniques are employed herein to direct conjugation to glutamine using glutamine conjugation via transglutaminase (see e.g., Schibli, *Angew Chemie* Inter Ed. 2010, 49, 9995).

Primary amine-comprising compounds (e.g., linkers L1) of the present disclosure can be conjugated to one or more glutamine residues of a binding agent (e.g., a protein, e.g., an antibody) via transglutaminase-based chemo-enzymatic conjugation (see, e.g., Dennler et al., *Protein Conjugate Chem.* 2014, 25, 569-578, and WO 2017/147542). For example, in the presence of transglutaminase, one or more glutamine residues of an antibody can be coupled to a primary amine linker compound. Briefly, in some embodiments, a binding agent having a glutamine residue (e.g., a gln295, i.e. Q295 residue) is treated with a primary amine-containing linker L1, described above, in the presence of the enzyme transglutaminase. In certain embodiments, the binding agent is aglycosylated. In certain embodiments, the binding agent is deglycosylated.

In certain embodiments, the binding agent (e.g., a protein, e.g., an antibody) comprises at least one glutamine residue in at least one polypeptide chain sequence. In certain embodiments, the binding agent comprises two heavy chain polypeptides, each with one gln295 residue. In further embodiments, the binding agent comprises one or more glutamine residues at a site other than a heavy chain 295.

In some embodiments, a binding agent, such as an antibody, can be prepared by site-directed mutagenesis to insert a glutamine residue at a site without resulting in disabled antibody function or binding. For example, included herein are antibodies bearing Asn297Gln (N297Q) mutation(s) as described herein. In some embodiments, an antibody having a gln295 residue and/or an N297Q mutation contains one or more additional naturally occurring glutamine residues in their variable regions, which can be accessible to transglutaminase and therefore capable of conjugation to a linker or a linker-payload. An exemplary naturally occurring glutamine residue can be found, e.g., at Q55 of the light chain. In such instances, the binding agent, e.g., antibody, conjugated via transglutaminase can have a higher than expected LAR value (e.g., a LAR higher than 4). Any such antibodies can be isolated from natural or artificial sources.

In certain embodiments of the disclosure, the linker-antibody ratio or LAR is from 1, 2, 3, 4, 5, 6, 7, or 8 linker L1 molecules per antibody. In some embodiments, the LAR is from 1 to 8. In some embodiments, the LAR is from 1 to 6. In certain embodiments, the LAR is from 2 to 4. In some cases, the LAR is from 2 to 3. In certain cases, the LAR is from 0.5 to 3.5. In some embodiments, the LAR is about 1, or about 1.5, or about 2, or about 2.5, or about 3, or about 3.5. In some embodiments, the LAR is 2. In some embodiments, the LAR is 4.

Step 2: Payload Conjugation Reaction

In certain embodiments, linkers L1 according to the present disclosure comprise a branching unit B, which comprises at least one reactive group B' capable of further reaction after transglutamination. In these embodiments, the glutaminyl-modified protein (e.g., antibody) is capable of further reaction with a reactive payload compound or a reactive linker-payload compound (e.g., L2-P as disclosed herein), to form a protein-payload conjugate. More specifically, the reactive linker-payload compound L2-P may comprise a reactive group B" that is capable of reacting with the reactive group B' of the linker L1. In certain embodiments, a reactive group B' according to the present disclosure comprises a moiety that is capable of undergoing a 1,3-cycloaddition reaction. In certain embodiments, the reactive group B' is an azide. In certain embodiments, the reactive group B" comprises an alkyne (e.g., a terminal alkyne, or an internal strained alkyne). In certain embodiments of the present disclosure the reactive group B' is compatible with the binding agent and transglutamination reaction conditions.

In certain embodiments of the disclosure, linker L1 molecules comprise a branching unit B which comprises one reactive group B'. In certain embodiments of the disclosure, linker L1 molecules comprise a branching unit B which comprises more than one reactive group B'.

In certain embodiments, the reactive linker-payload L2-P comprises one payload molecule (n=1). In certain other embodiments, the reactive linker-payload L2-P comprises two or more payload molecules (n 2). In certain embodiments, the reactive linker-payload L2-P comprises from 1 to 12 payload molecules, or from 1 to 10 payload molecules, or from 1 to 8 payload molecules, or from 1 to 6 payload molecules, or from 1 to 4 payload molecules, or from 1 to 2 payload molecules.

In certain embodiments, the reactive linker-payload L2-P comprises one payload molecule. When such L2-P is reacted with a BA-L1-B, the DAR will be about equal to the LAR of the BA-L1-B. For example, if L2-P comprising one payload molecule is reacted with a BA-L1-B having a LAR of 4 (e.g., via Q295 and N297Q transglutamination), the resulting protein-drug conjugate will have a DAR of 4.

In certain embodiments, the reactive linker-payload L2-P comprises 2 payload molecules. When such L2-P is reacted with a BA-L1-B, the DAR will be about 2 times the LAR of the BA-L1-B. For example, if L2-P comprising 2 payload molecules is reacted with a BA-L1-B having a LAR of 4 (e.g., via Q295 and N297Q transglutamination), the resulting protein-drug conjugate will have a DAR of 8.

For example, if L2-P comprising 3 payload molecules is reacted with a BA-L1-B having a LAR of 8 (e.g., via Q295 and N297Q transglutamination of a branched L1-B unit comprising 2 groups B), the resulting protein-drug conjugate will have a DAR of 24.

In certain embodiments of the disclosure, the drug-antibody ratio or DAR (e.g., abbreviated as the lower case letter n) is from about 1 to about 30, or from about 1 to about 24, or from about 1 to about 20, or from about 1 to about 16, or from about 1 to about 12, or from about 1 to about 10, or from about 1 to about 8, or about 1, 2, 3, 4, 5, 6, 7, or 8 payload molecules per antibody. In some embodiments, the DAR is from 1 to 30. In some embodiments, the DAR is from 1 to 24. In some embodiments, the DAR is from 1 to 16. In some embodiments, the DAR is from 1 to 8. In some embodiments, the DAR is from 1 to 6. In certain embodiments, the DAR is from 2 to 4. In some cases, the DAR is from 2 to 3. In certain cases, the DAR is from 0.5 to 3.5. In certain cases, the DAR is from 10 to 14. In certain cases, the DAR is from 14 to 18. In certain cases, the DAR is from 20 to 24.5. In some embodiments, the DAR is about 1, or about 1.5, or about 2, or about 2.5, or about 3, or about 3.5. In some embodiments, the DAR is 2. In some embodiments, the DAR is 4. In some embodiments, the DAR is 8. In some embodiments, the DAR is 12. In some embodiments, the DAR is 16. In some embodiments, the DAR is 24.

In one aspect, the present disclosure provides a method of producing a compound having a structure according to Formula (A):

$$BA\text{-}(Gln\text{-}NH\text{-}L1\text{-}B\text{-}(\text{-}L2\text{-}(\text{-}M\text{-}Dxd)_m)_k)_n \quad (A),$$

wherein BA is an antibody or an antigen-binding fragment thereof;

Gln is a glutamine residue;

L1 is a first linker;

B is a branching unit comprising at least one adduct of a group B' and a group B";

L2 is a second linker covalently attached to the branching unit B via at least one group B";

M is absent or

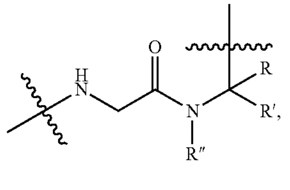

where R, R', and R" are independently at each occurrence hydrogen or a $C_1$-$C_4$ alkyl, or wherein R' and R" together form a 5-membered or a 6-membered ring;

Dxd is an anti-tumor agent comprising a structure according to Formula (P):

(P)

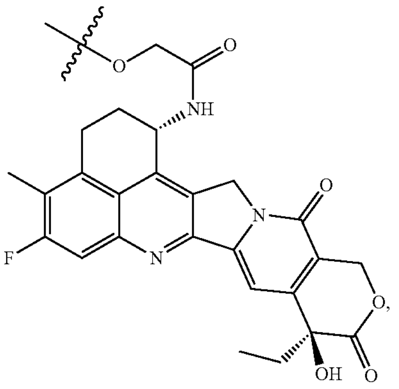

k and m are independently an integer from 1 to 12, and n is an integer from 1 to 30, wherein:

the method comprises the steps of:

a) contacting, in the presence of a transglutaminase, the BA comprising at least one glutamine residue Gln (BA-Gln-$NH_2$) with a compound L1-B, wherein the branching unit B comprises the at least one group B', b) contacting the product of step a) with k or more equivalents of a compound L2-(-M-Dxd)$_m$, wherein the linker L2 comprises at least one group B", wherein one of the groups B' and B" is selected from —$N_3$ and

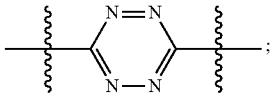 [SMILES: *c1nnc(*)nn1];

and the other of the groups B' and B" is selected from

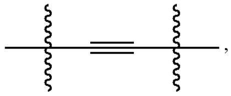,

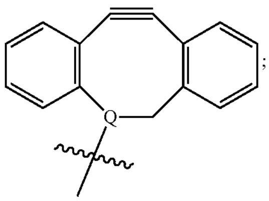; and 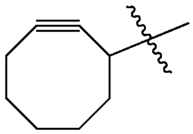, where Q is C or N; and c) isolating the produced compound of Formula (I).

In one aspect, the present disclosure provides a method of producing a compound having a structure according to Formula (A):

$$\text{BA-(Gln-NH-L1-B-(-L2-(-M-Dxd)}_m)_k)_n \quad \text{(A)},$$

wherein BA is an antibody or an antigen-binding fragment thereof; Gln is a glutamine residue; L1 is a first linker as described above; B is a branching unit comprising at least one adduct of a group B' and a group B" as described above; L2 is a second linker as described above covalently attached to the branching unit B via at least one group B" as described above; M is absent or

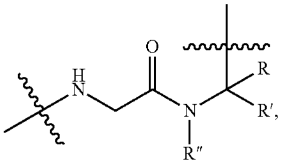

where R, R', and R" are as described above; Dxd is an anti-tumor agent comprising a structure according to Formula (P):

(P)

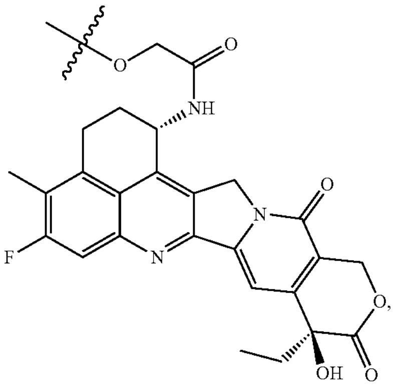

k and m are independently an integer from 1 to 12, and n is an integer from 1 to 30, wherein:

the method comprises the steps of:

a) contacting a compound L1-B, wherein the branching unit B comprises the at least one group B', with k or more equivalents of a compound L2-(-M-Dxd)$_m$, wherein the linker L2 comprises at least one group B" capable of covalently binding with the group B', wherein one of the groups B' and B" is selected from —$N_3$ and

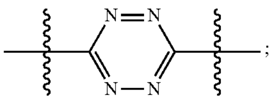 [SMILES: *c1nnc(*)nn1];

and the other of the groups B' and B" is selected from

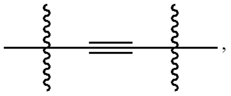,

-continued

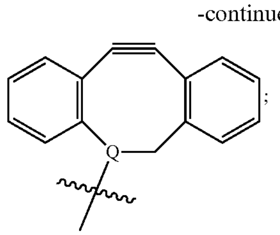

; and

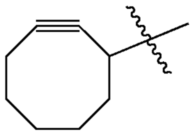

, where Q is C or N;

thereby producing L1-B-(-L2-(-M-Dxd$)_m)_k$;

b) contacting, in the presence of a transglutaminase, the BA comprising at least one glutamine residue Gln ($BA-Gln-NH_2$) with the L1-B-(-L2-(-M-Dxd$)_m)_k$ product of step a), and c) isolating the produced compound of Formula (I).

In one aspect, the present disclosure provides a method of producing a compound having a structure according to Formula (I):

BA-(Gln-NH-L1-B-(-L2-M-Dxd$)_k)_n$ (I), wherein BA is an antibody or an antigen-binding fragment thereof;

Gln is a glutamine residue;

L1 is a first linker;

B is a branching unit comprising at least one adduct of a group B' and a group B";

L2 is a second linker covalently attached to the branching unit B via at least one group B";

M is absent or

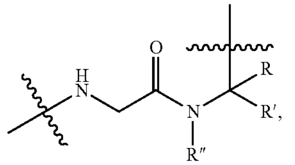

where R, R', and R" are independently at each occurrence hydrogen or a $C_1$-$C_4$ alkyl, or wherein R' and R" together form a 5-membered or a 6-membered ring;

Dxd is an anti-tumor agent comprising a structure according to Formula (P):

(P)

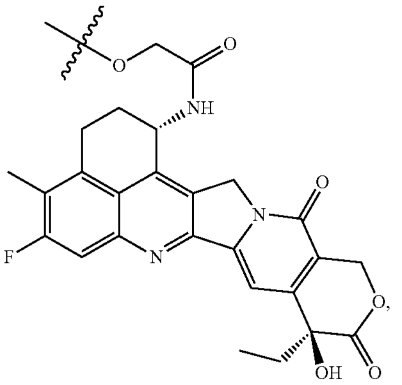

k is an integer from 1 to 12, and n is an integer from 1 to 30, wherein:

the method comprises the steps of:

a) contacting, in the presence of a transglutaminase, the BA comprising at least one glutamine residue Gln ($BA-Gln-NH_2$) with a compound L1-B, wherein the branching unit B comprises the at least one group B', b) contacting the product of step a) with k or more equivalents of a compound L2-M-Dxd, wherein the linker L2 comprises the at least one group B" capable of covalently attaching to the group B', wherein one of the groups B' and B" is selected from —$N_3$ and

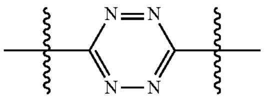

;

and the other of the groups B' and B" is selected from

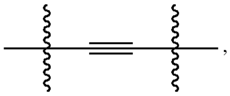

,

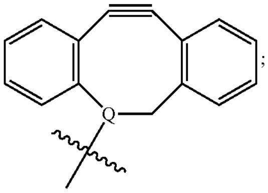

; and

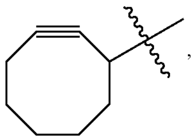

, where Q is C or N; and c) isolating the produced compound of Formula (I).

In one aspect, the present disclosure provides a method of producing a compound having a structure according to Formula (I):

BA-(Gln-NH-L1-B-(-L2-M-Dxd$)_k)_n$ (1), wherein BA is an antibody or an antigen-binding fragment thereof; Gln is a glutamine residue; L1 is a first linker as described above; B is a branching unit comprising at least one adduct of a group B' and a group B" as described above; L2 is a second linker as described above covalently attached to the branching unit B via at least one group B" as described above; M is absent or

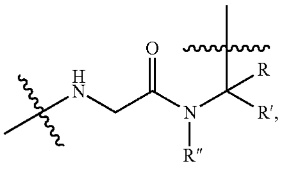

where R, R', and R" are as described above; Dxd is an anti-tumor agent comprising a structure according to Formula (P):

(P)

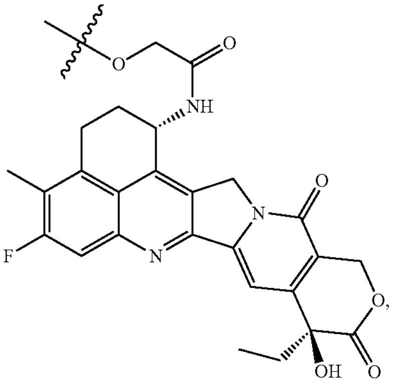

k is an integer from 1 to 12, and n is an integer from 1 to 30, wherein:

the method comprises the steps of:

a) contacting a compound L1-B, wherein the branching unit B comprises the at least one group B' with k or more equivalents of a compound L2-M-Dxd, wherein the linker L2 comprises at least one group B", thereby producting L1-B-(-L2-M-Dxd)$_k$, wherein one of the groups B' and B" is selected from $—N_3$ and

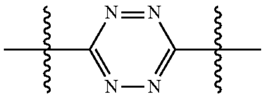

;

and the other of the groups B' and B" is selected from

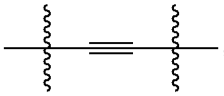

,

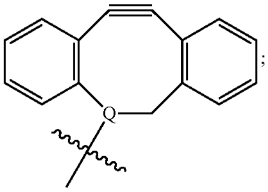

; and

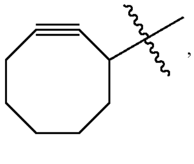

, where Q is C or N;

b) contacting, in the presence of a transglutaminase, the binding agent BA comprising at least one glutamine residue Gln (BA-Gln-$NH_2$) with the L1-B-(-L2-M-Dxd)$_k$ product of step a), and c) isolating the produced compound of Formula (I).

In one aspect, the present disclosure provides a method of producing a compound having a structure according to Formula (III):

BA-(Gln-NH-L2'-P))$_n$ (III), wherein BA is an antibody or an antigen-binding fragment thereof; Gln is a glutamine residue; L2'-P is $H_2N$-SP1-B2-(-SP2-AA-SP3-M-Dxd)p as described above, and n is an integer from 1 to 30;

SP1 is absent or a first spacer unit selected from the group consisting of

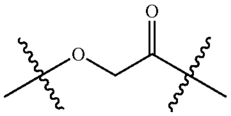

and

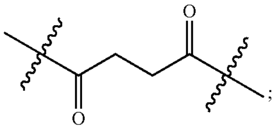

;

B2 is absent or a branching unit;

SP2 is absent or a second spacer unit selected from the group consisting of a $C_{1-6}$ alkyl, $—(CH_2—CH_2—O)_v—$, —NH—, —C(O)—, —NH—C(O)—, $—NH—(CH_2)_u—$, $—NH—(CH_2)_u—C(O)—$, $—NH—(CH_2—CH_2—O)_v—$, $—NH—(CH_2—CH_2—O)_v—C(O)—$, $—NH—(CH_2—CH_2—O)_v—(CH_2)_u—$, $—NH—(CH_2—CH_2—O)_v—(CH_2)_u—C(O)—$, $—(CH_2)_u—NH—C(O)—$, $—NH—(CH_2)_u—NH—C(O)—$, $—NH—(CH_2)_u—C(O)—NH—$, or combinations thereof; wherein subscripts u and v are independently an integer from 1 to 8;

AA is absent or a peptide unit comprising from 2 to 4 amino acids;

SP3 is absent or a third spacer unit selected from the group consisting of,

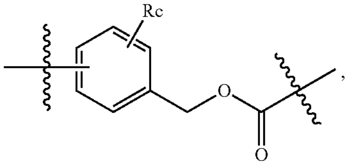

,

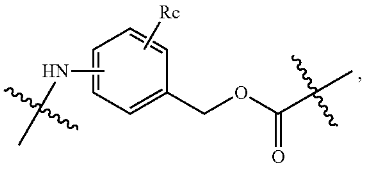

,

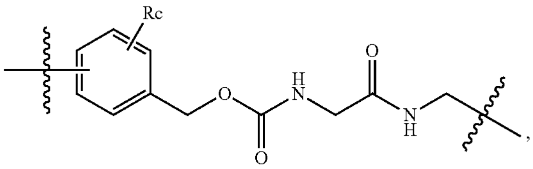

,

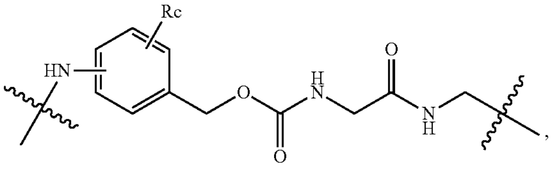

, wherein $R_c$ is independently at each occurrence absent or a group selected from

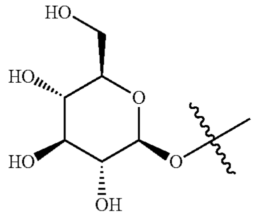

and

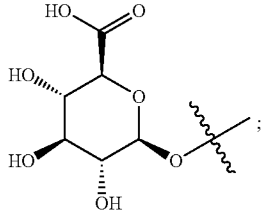

;

M is absent or

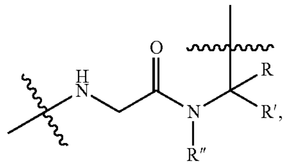

where R, R', and R" are independently at each occurrence hydrogen or a $C_1$-$C_4$ alkyl, or wherein R' and R" together form a 5-membered or a 6-membered ring; and Dxd is an anti-tumor agent having a structure according to Formula (P):

(P)

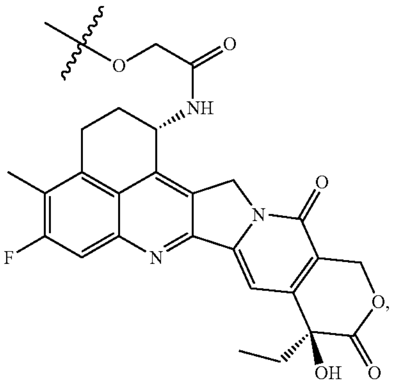

p is an integer from 1 to 30;

wherein the method comprises the steps of:

b) contacting, in the presence of a transglutaminase, the BA comprising at least one glutamine residue Gln ($BA-Gln-NH_2$) with the L2'-P, and c) isolating the produced compound of Formula (III).

In one aspect, the present disclosure provides a method of producing a compound having a structure according to Formula (I):

$$BA\text{-}(Gln\text{-}NH\text{-}L1\text{-}B\text{-}(\text{-}L2\text{-}M\text{-}Dxd)_k)_n \quad (I),$$

wherein BA is an antibody or an antigen-binding fragment thereof; Gln is a glutamine residue; L1 is a first linker as described above; B is a branching unit comprising at least one group B' as described above; L2 is a second linker as described above covalently attached to the branching unit B via at least one group B" as described above, wherein the group B' and the group B" form the at least one adduct as described above; M is absent or

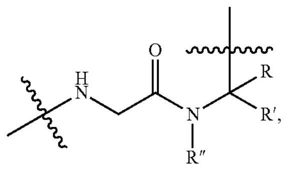

where R, R', and R" are as described above; Dxd is an anti-tumor agent comprising a structure according to Formula (P):

(P)

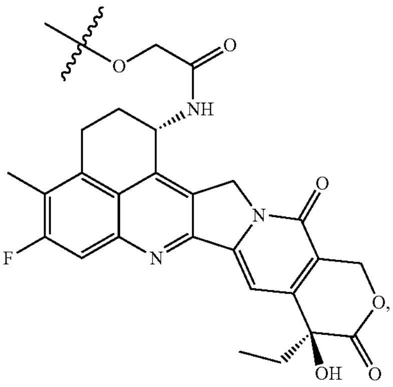

k is an integer from 1 to 12, and n is an integer from 1 to 30, wherein:

the method comprises the steps of:

a) contacting, in the presence of a transglutaminase, the binding agent BA comprising at least one glutamine residue Gln ($BA-Gln-NH_2$) with a compound L1-B, wherein the branching unit B comprises the at least one group B' selected from

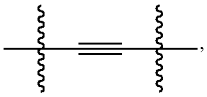,
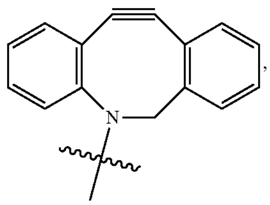,
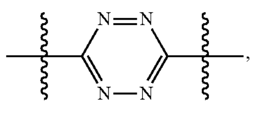,
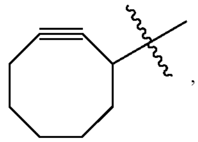, thereby producing BA-Gln-NH-L1-B;

b) contacting the product of step a) with k or more equivalents of a compound L2-M-Dxd, wherein the linker L2 comprises at least one group B" capable of covalently binding with the group B', and c) isolating the produced compound of Formula (I).

In another aspect, the present disclosure provides a method of producing a compound having a structure according to Formula (I):

$$BA\text{-}(Gln\text{-}NH\text{-}L1\text{-}B\text{-}(\text{-}L2\text{-}M\text{-}Dxd)_k)_n \quad (I),$$

wherein BA is an antibody or an antigen-binding fragment thereof; Gln is a glutamine residue; L1 is a first linker as described above; B is a branching unit comprising at least one group B' as described above; L2 is a second linker as described above covalently attached to the branching unit B via at least one group B" as described above, wherein the group B' and the group B" form the at least one adduct as described above; M is absent or

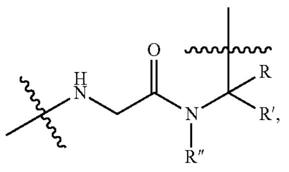

where R, R', and R" are as described above; Dxd is an anti-tumor agent comprising a structure according to Formula (P):

(P)

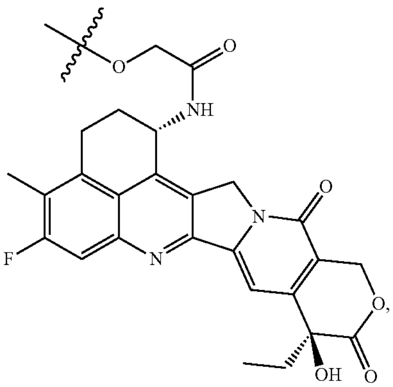

k is an integer from 1 to 12, and n is an integer from 1 to 30, wherein:

the method comprises the steps of:

a) contacting a compound L1-B, wherein the branching unit B comprises the at least one group B' selected from —N,

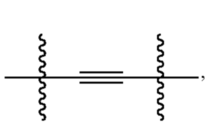
,
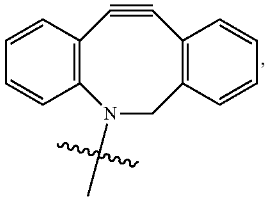
,

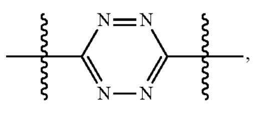
,
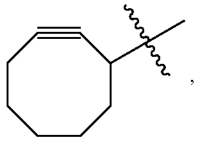
, with k or more equivalents of a compound L2-M-Dxd, wherein the linker L2 comprises at least one group B" capable of covalently binding with the group B', thereby producting L1-B-(-L2-M-Dxd)$_k$;

b) contacting, in the presence of a transglutaminase, the binding agent BA comprising at least one glutamine residue Gln (BA-Gln-$NH_2$) with the L1-B-(-L2-M-Dxd)$_k$ product of step a), and c) isolating the produced compound of Formula (I).

In one embodiment, the glutamine residue Gln is naturally present in a CH2 or CH3 domain of the BA. In another embodiment, the glutamine residue Gln is introduced to the BA by modifying one or more amino acids. In one embodiment, the Gln is Q295 or N297Q.

In one embodiment, the transglutaminase is microbial transglutaminase (MTG). In one embodiment, the transglutaminase is bacterial transglutaminase (BTG).

In one embodiment, M is absent. In another embodiment, M-Dxd is has a structure selected from the group consisting of

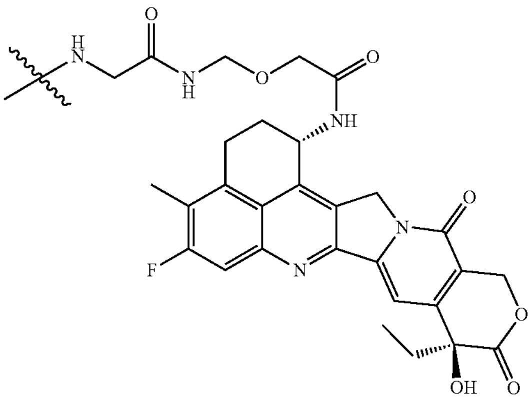

and

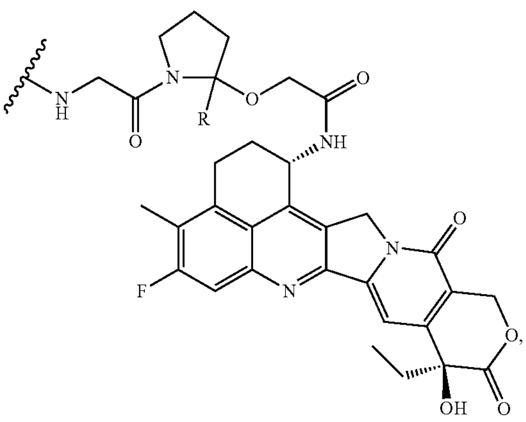

wherein R is a hydrogen or a C1-C4 alkyl, and where ∿∿ represents the point of attachment to L2.

In one embodiment, the compound L2-Dxd has a structure selected from the group consisting of:

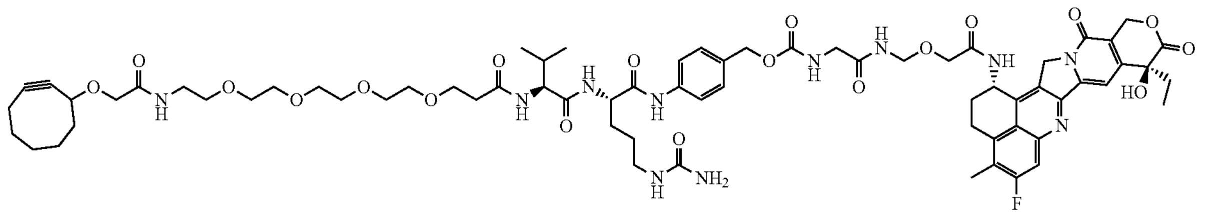
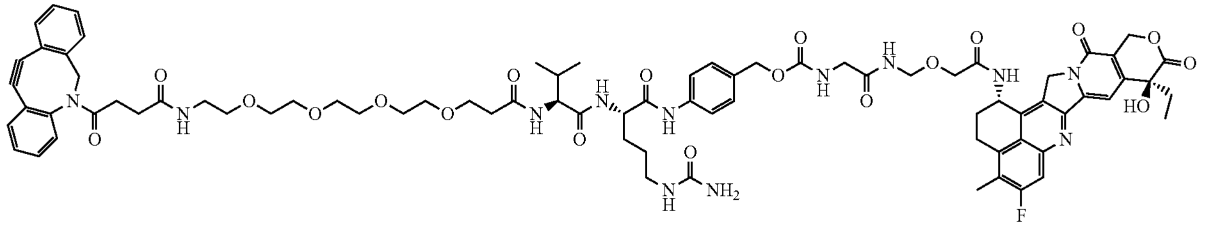
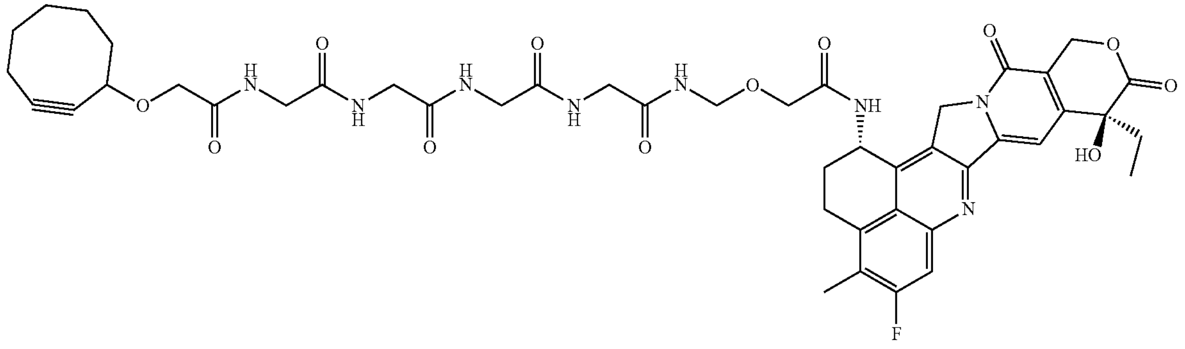
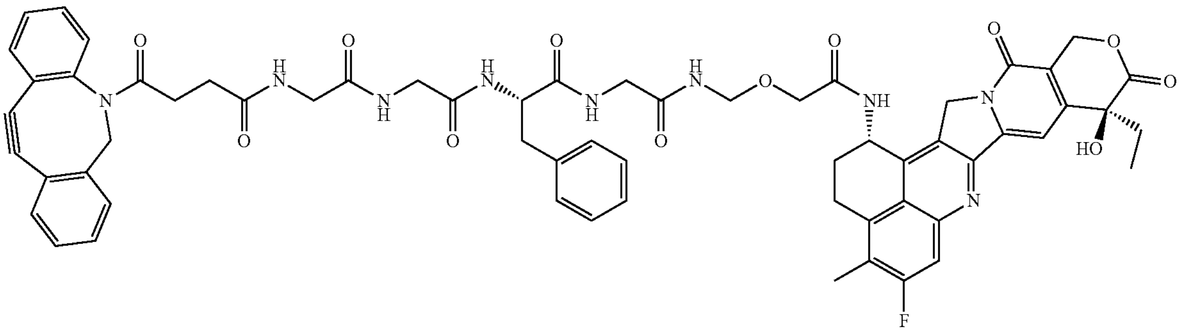
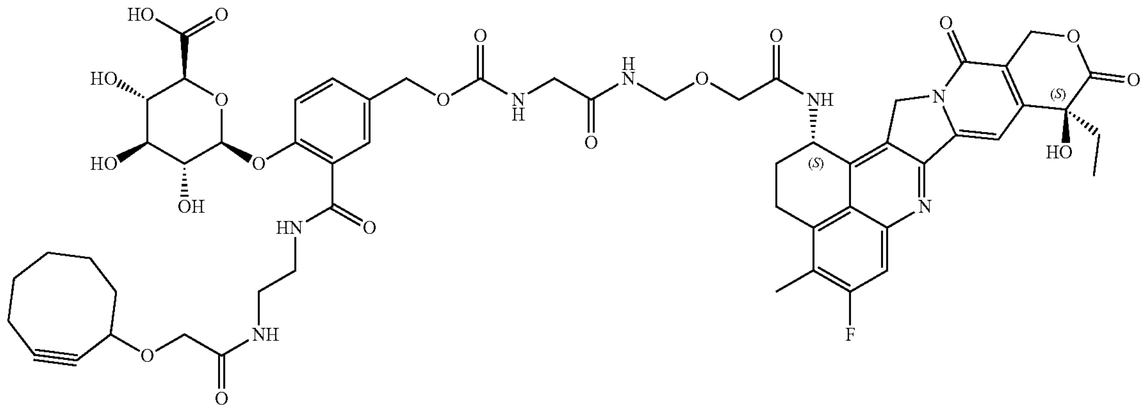

-continued
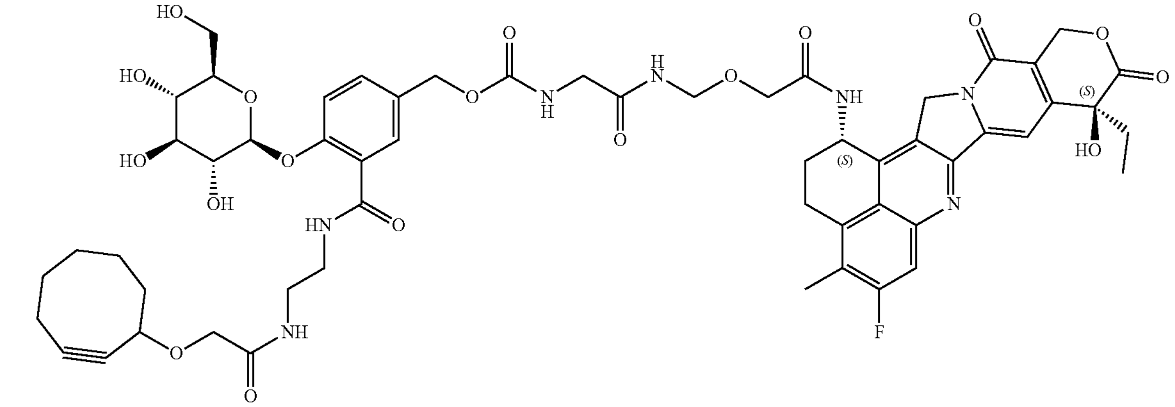
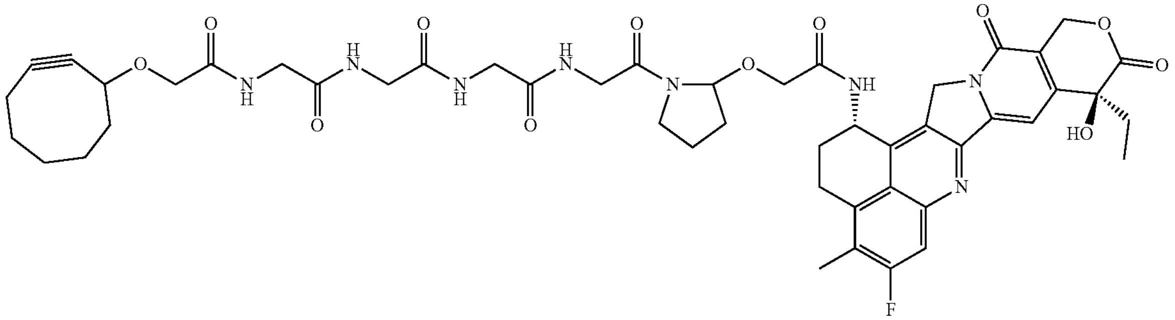
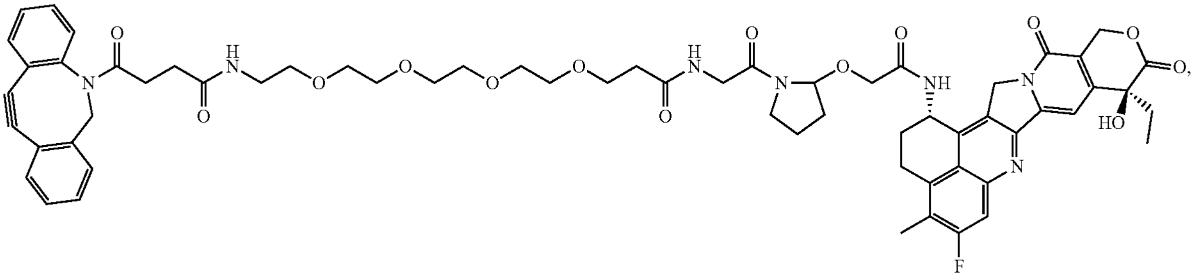
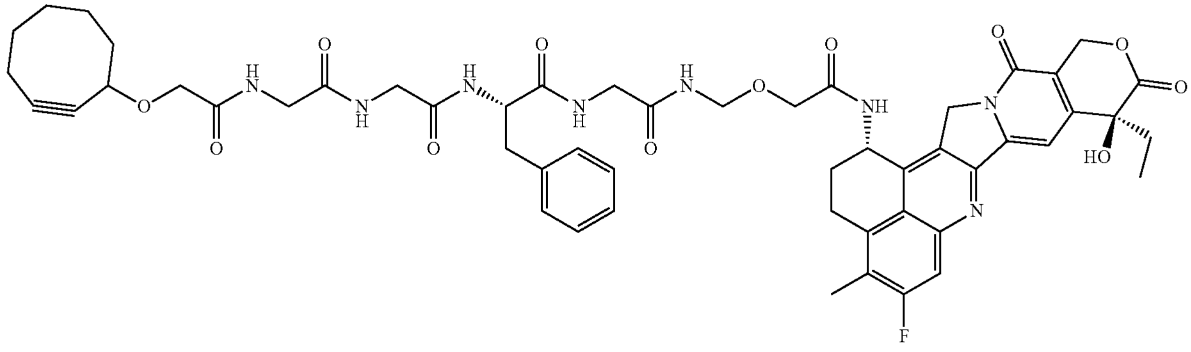
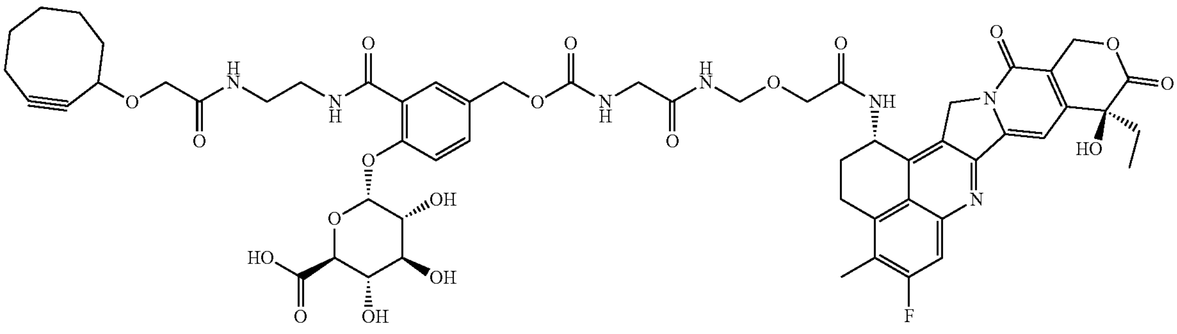

-continued
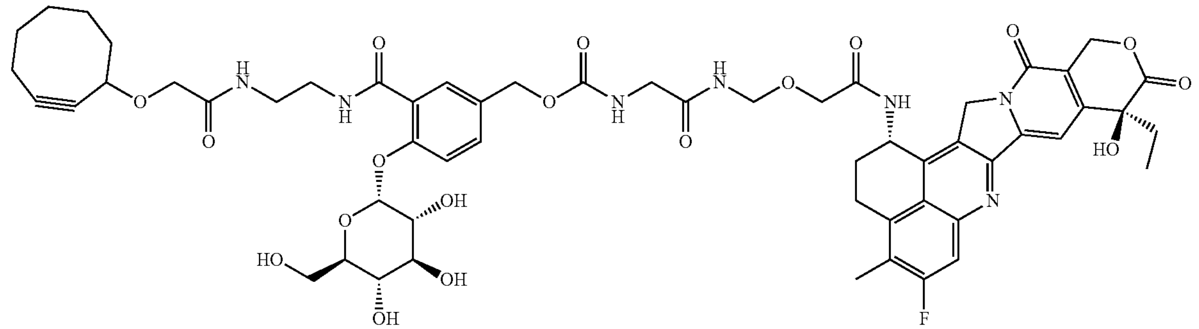
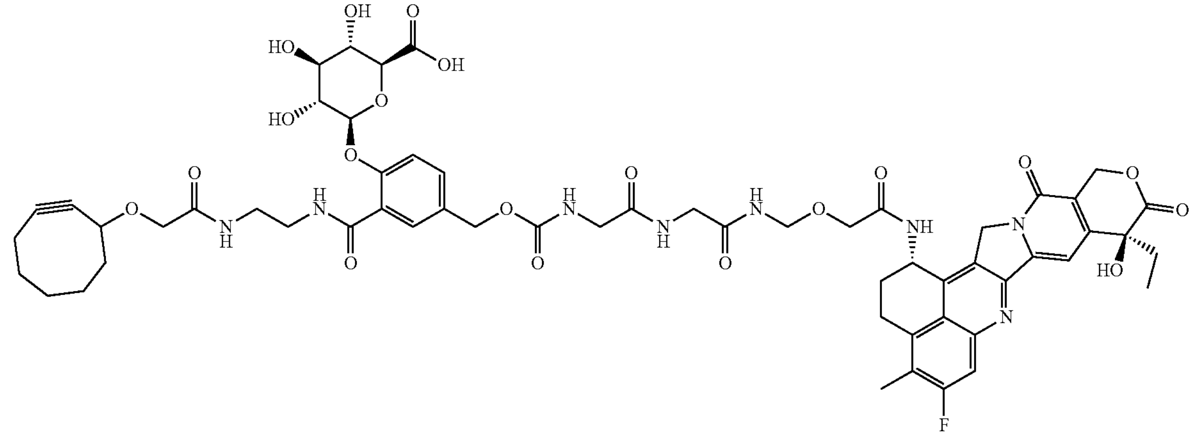
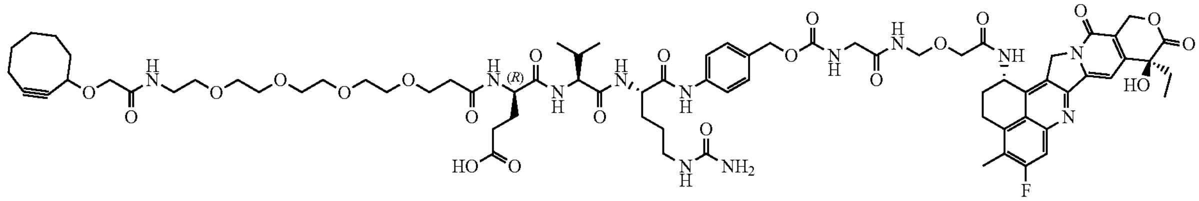
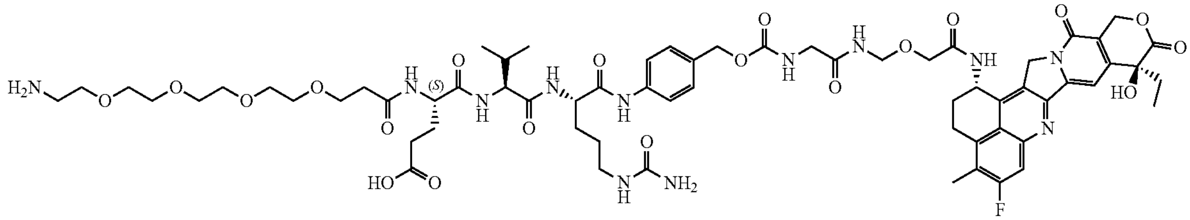
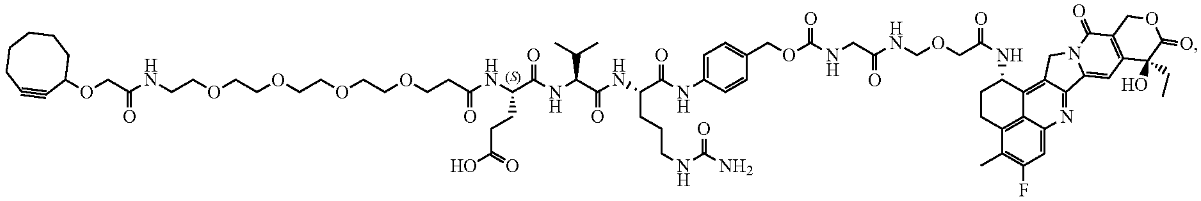
,
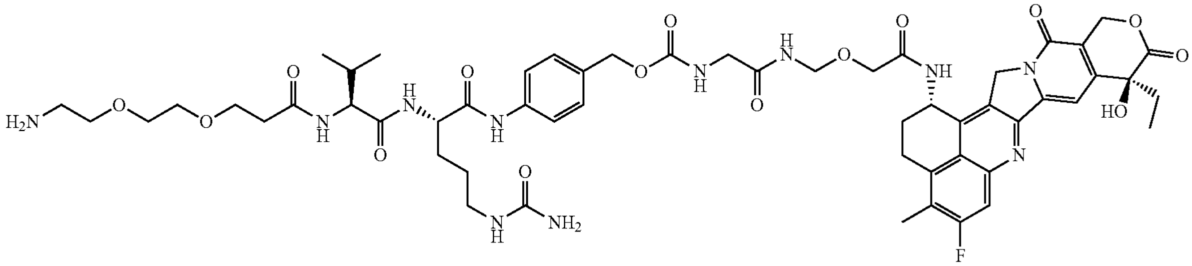

-continued
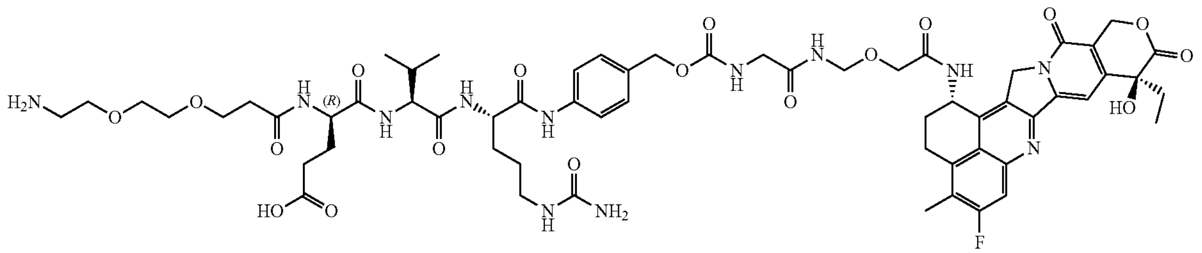
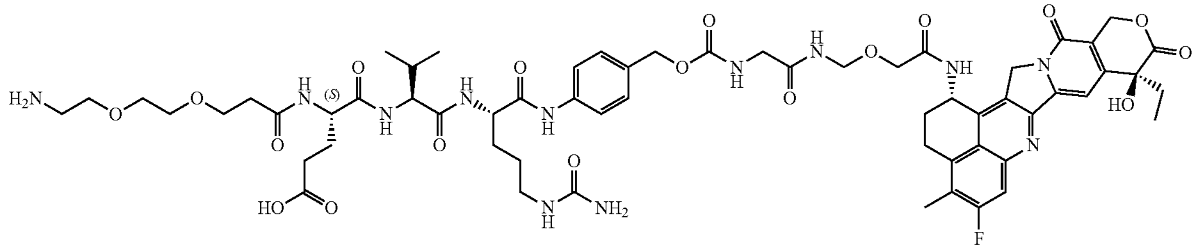
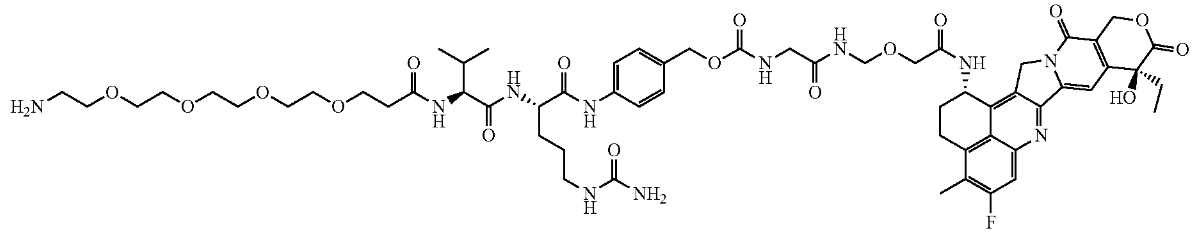
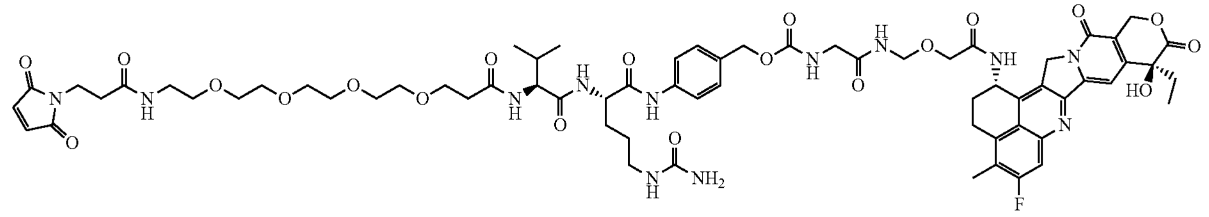
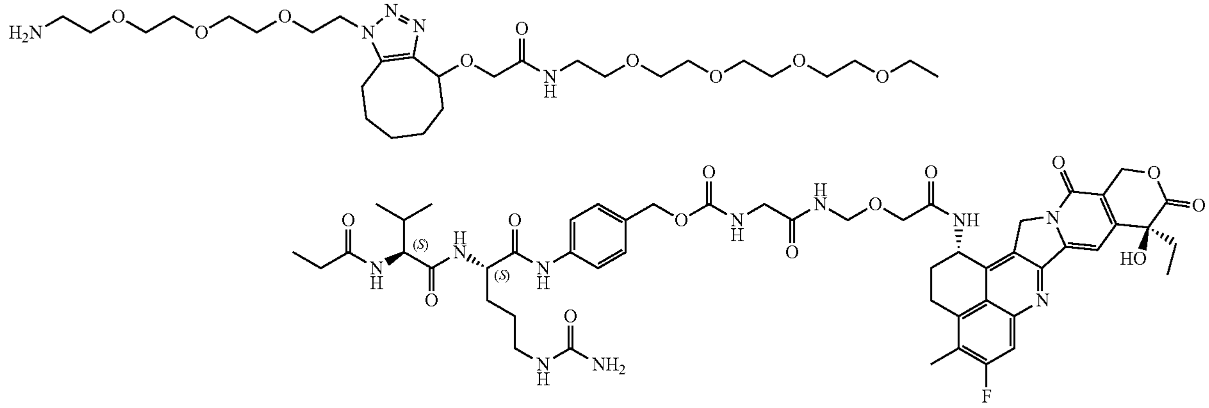
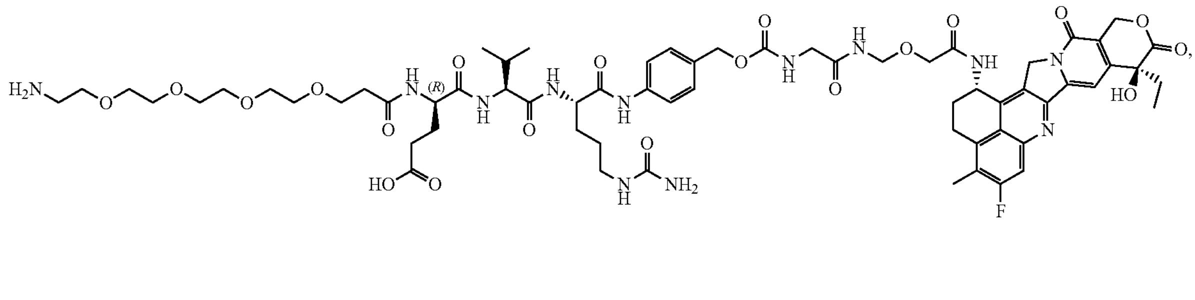
, -continued

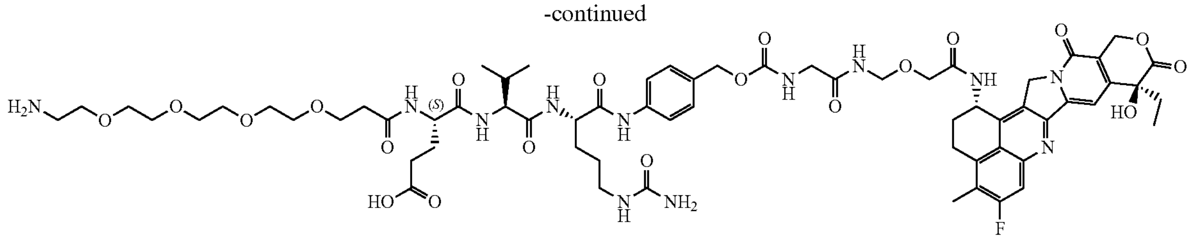

or a pharmaceutically acceptable salt thereof.

In one embodiment, the compound L2-Dxd encompasses an optional branching unit B2. In such embodiments, the compound L2-Dxd comprises 2 or more Dxd units.

In one embodiment, the branching unit B2 has a structure selected from the group consisting of:

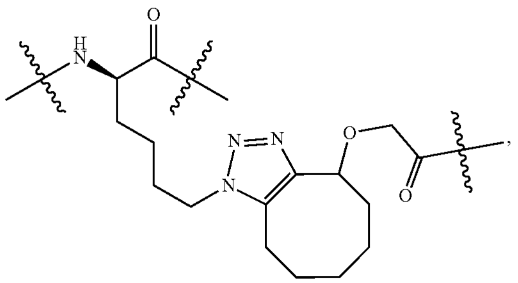

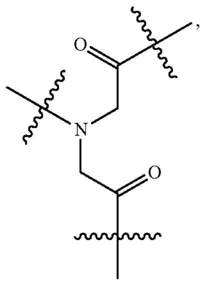

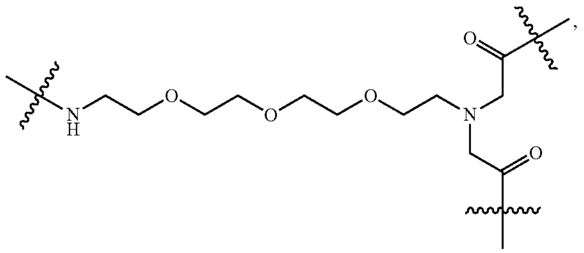

-continued

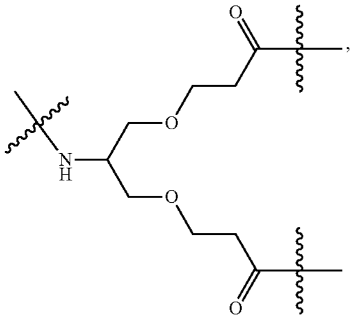

and

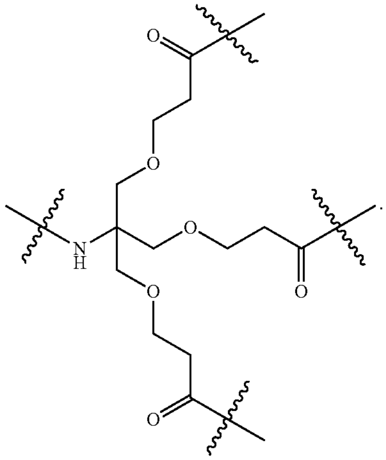

In one embodiment, the compound L2-Dxd has a structure selected from the group

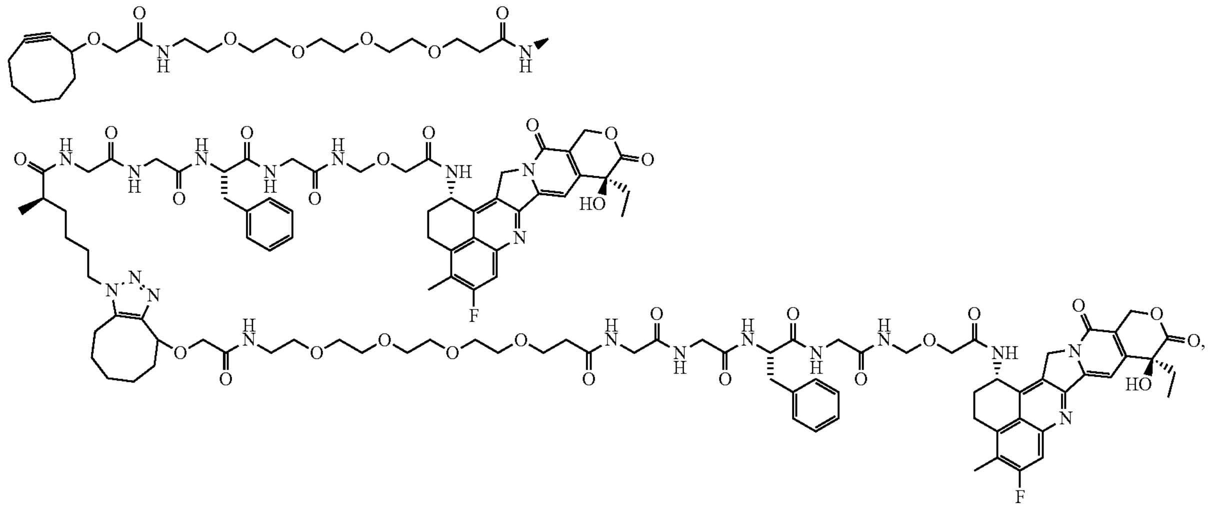
,
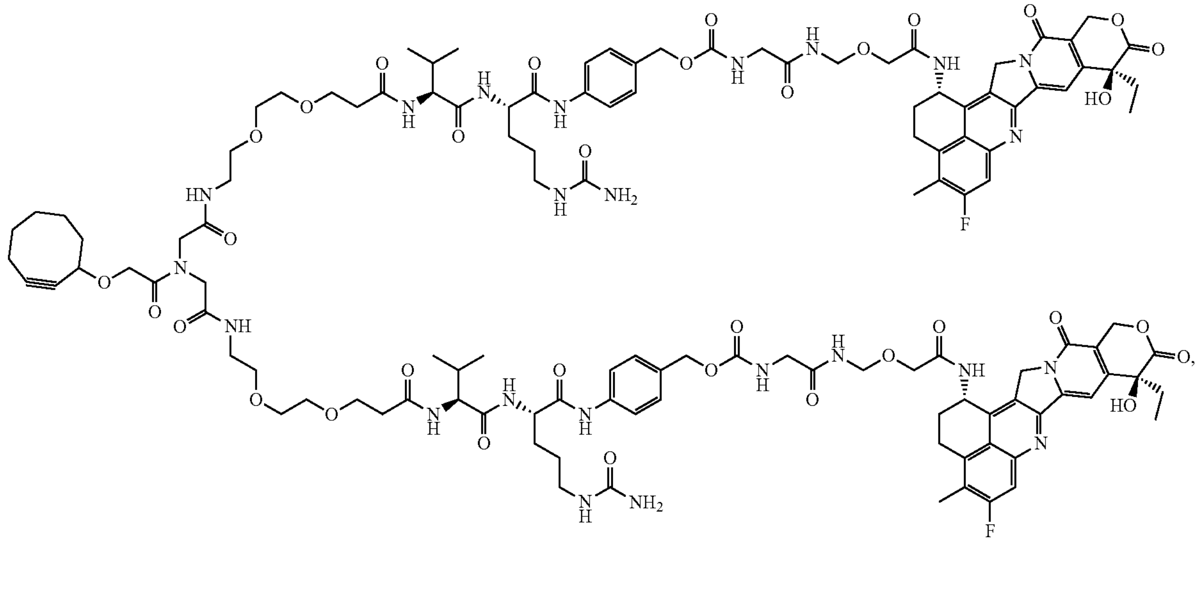
,
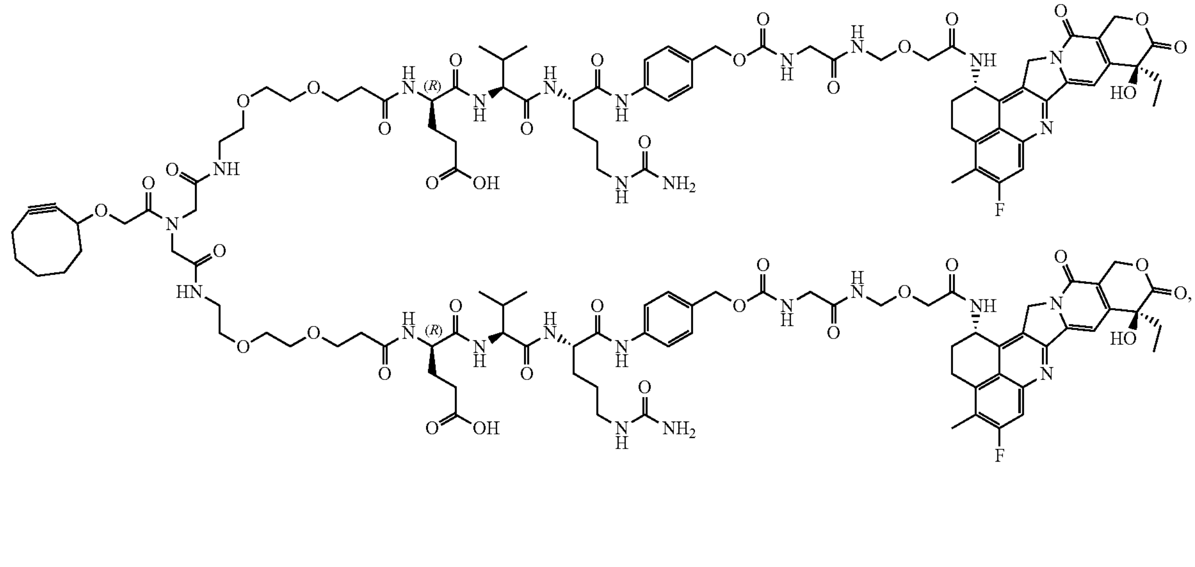
,

-continued
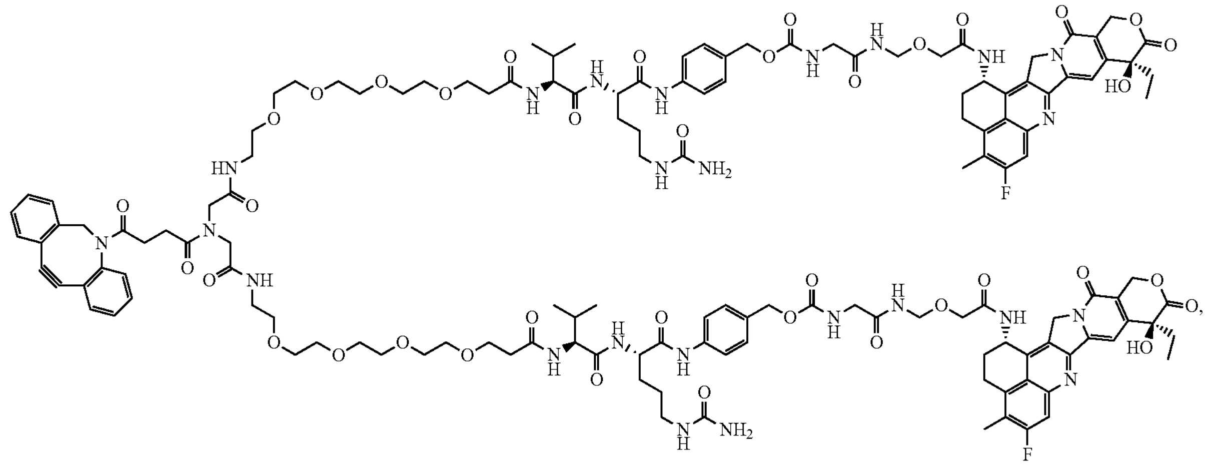
,
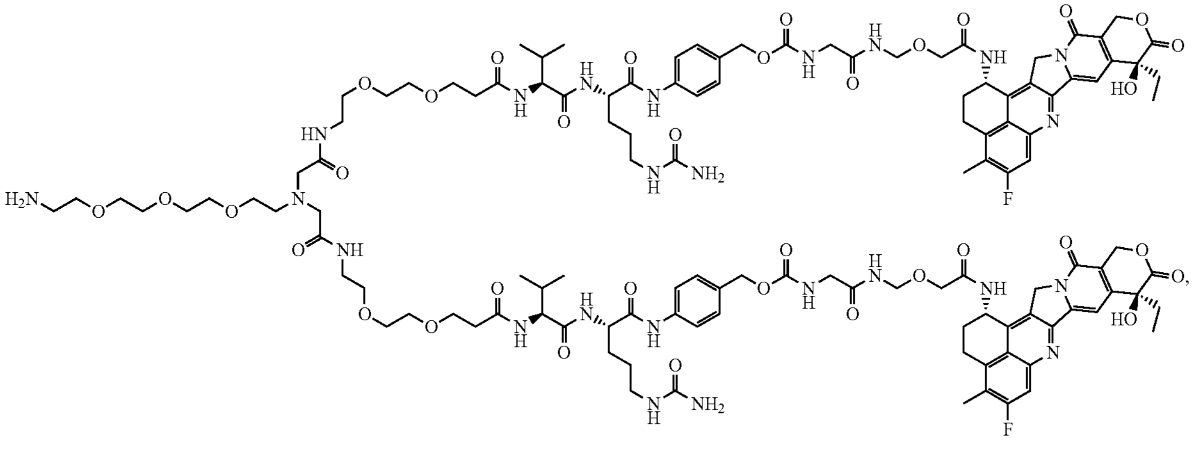
,
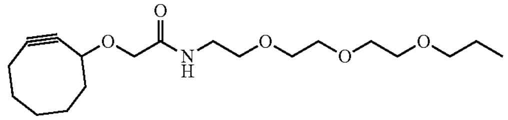
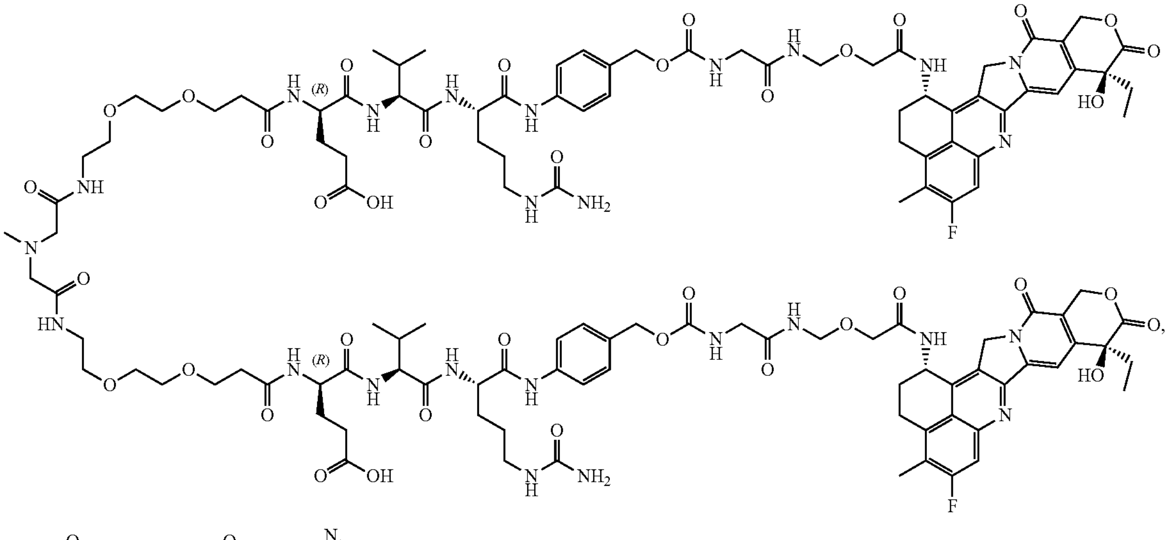
,
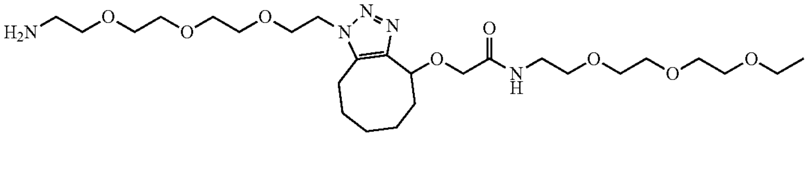

-continued
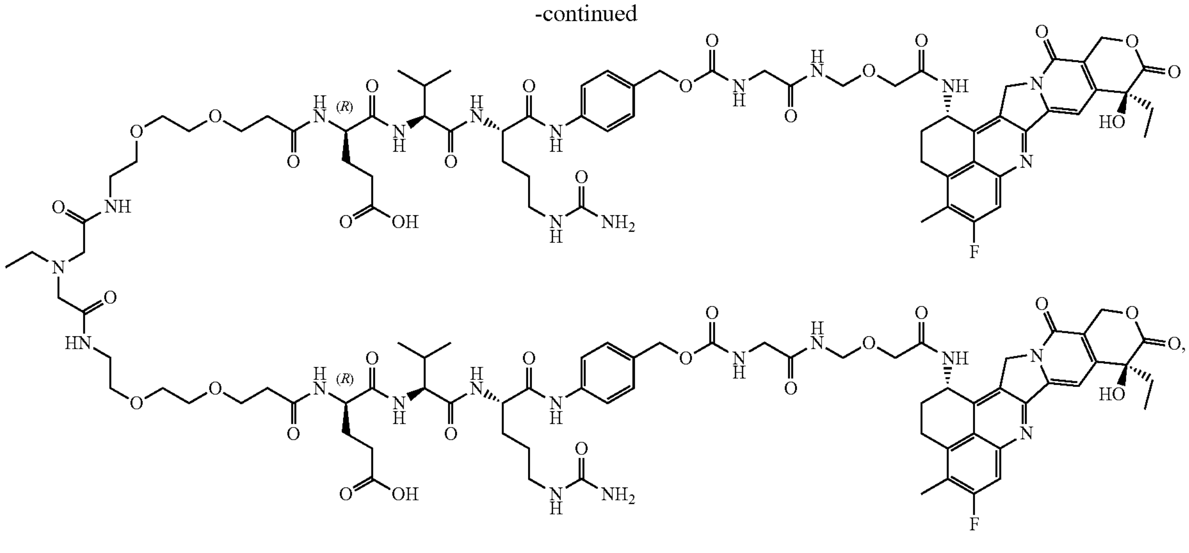
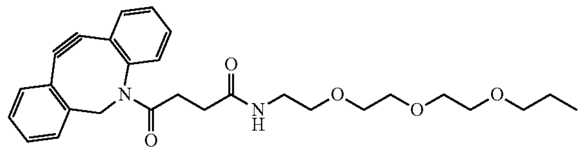
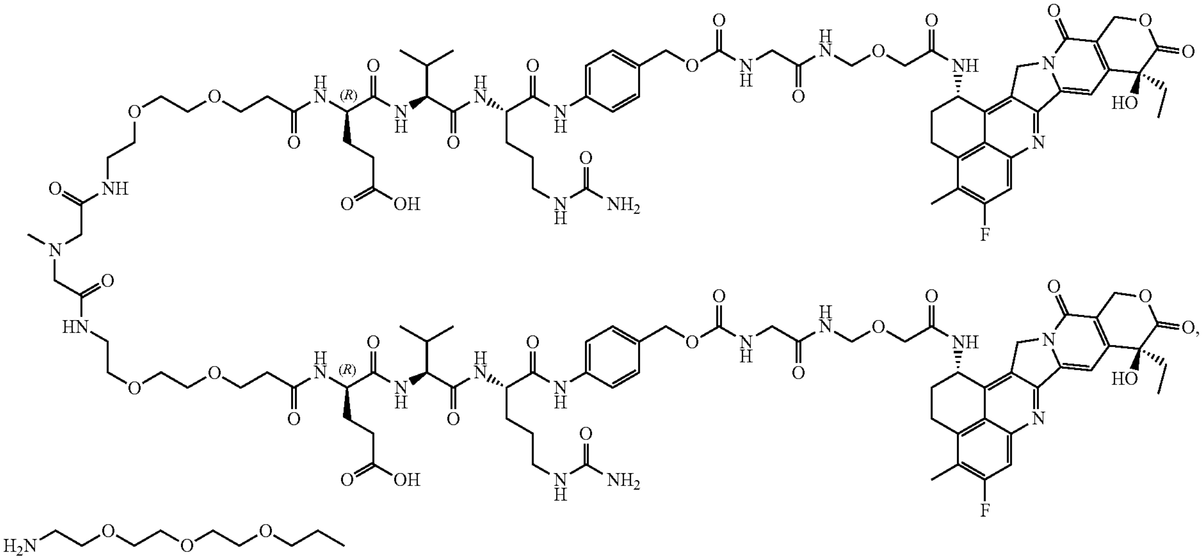
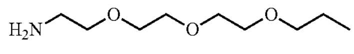

-continued
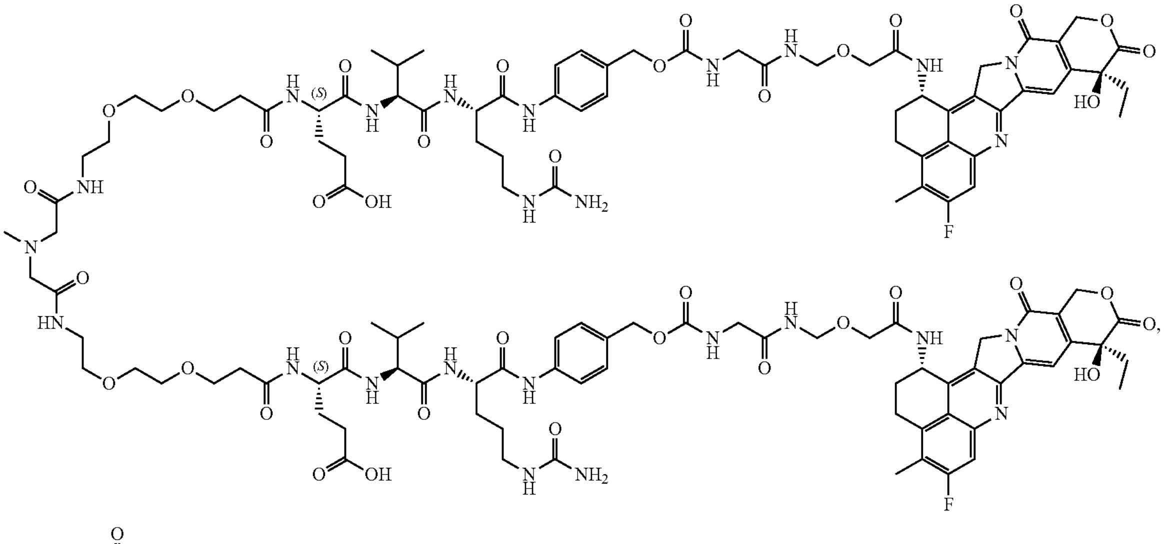
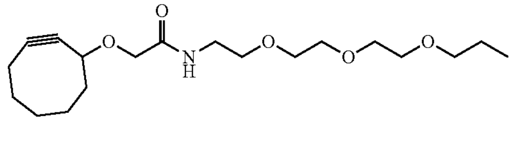
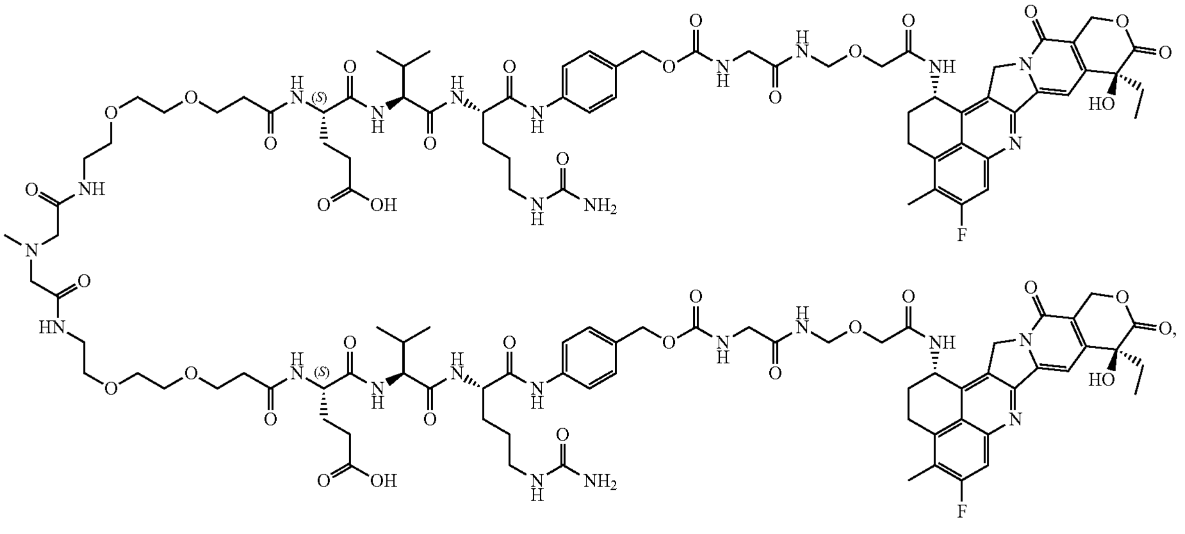
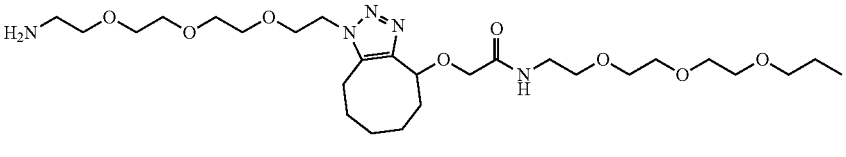

-continued
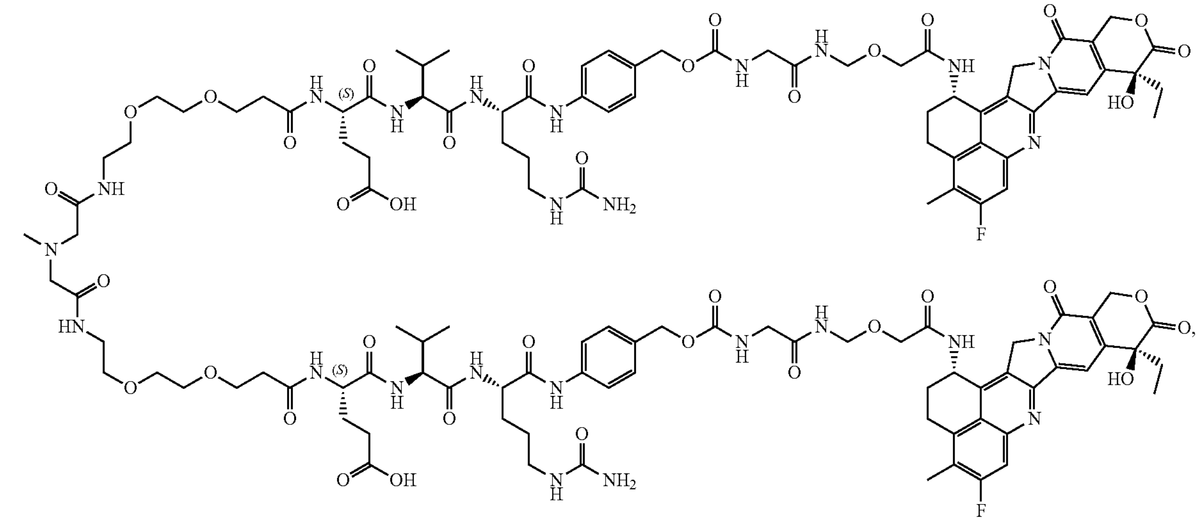
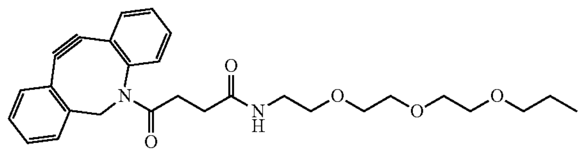
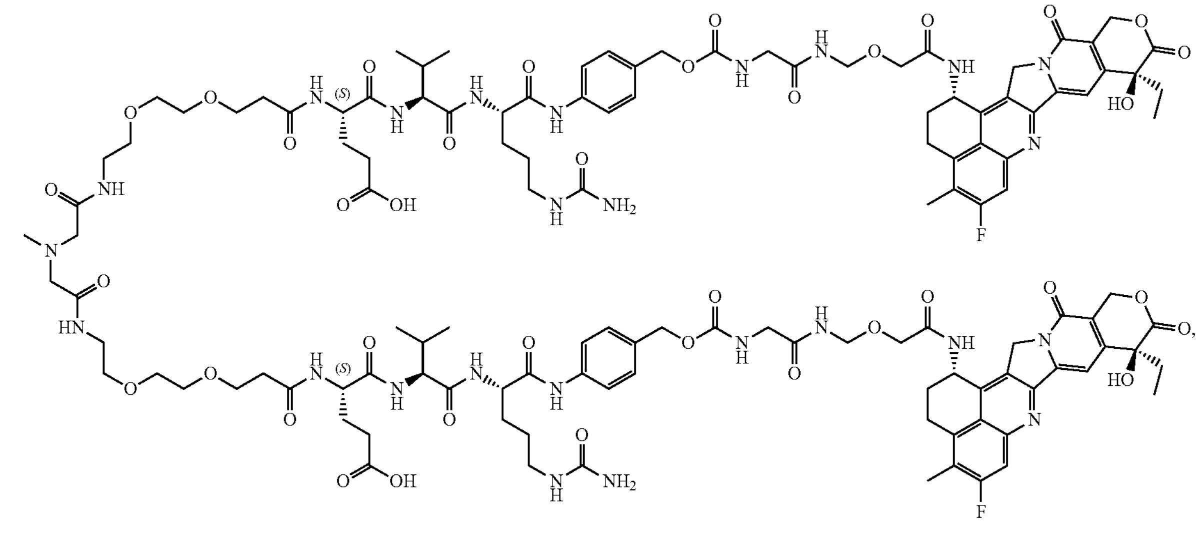
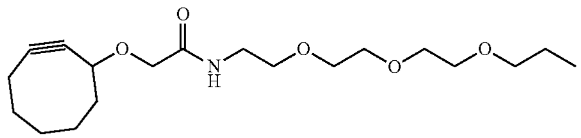

-continued
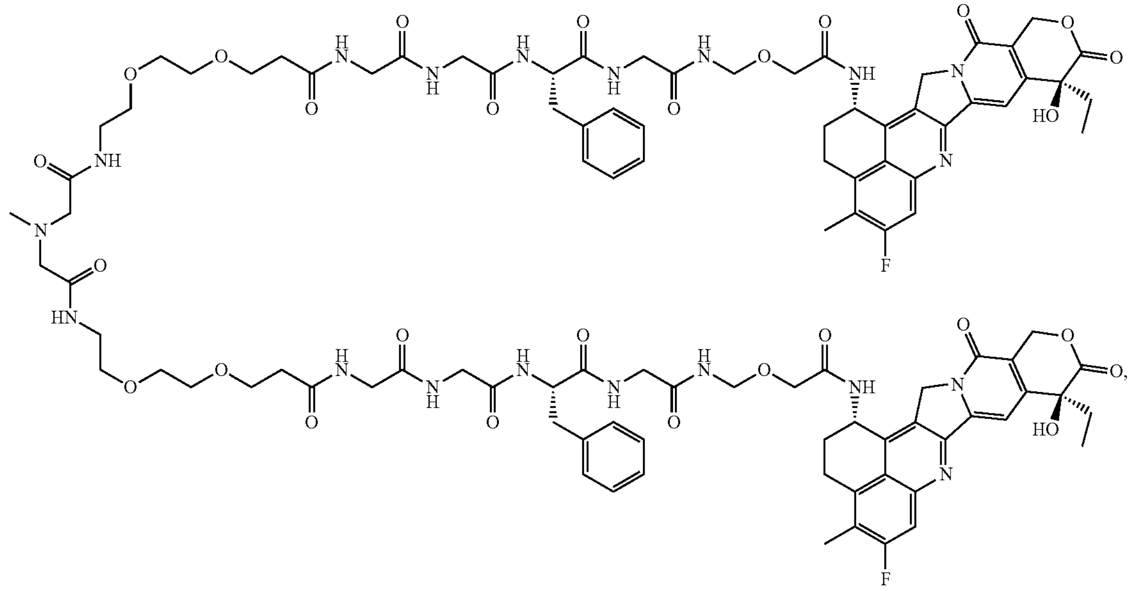
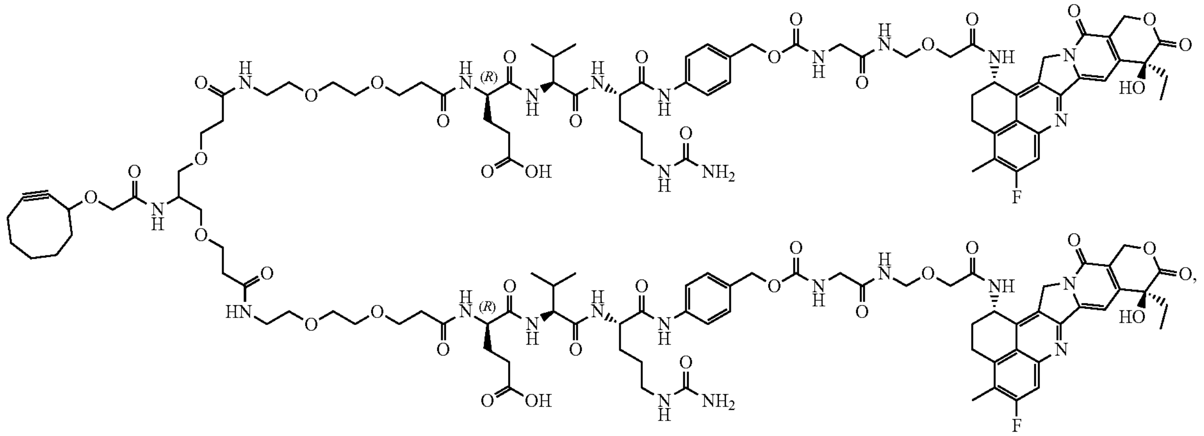
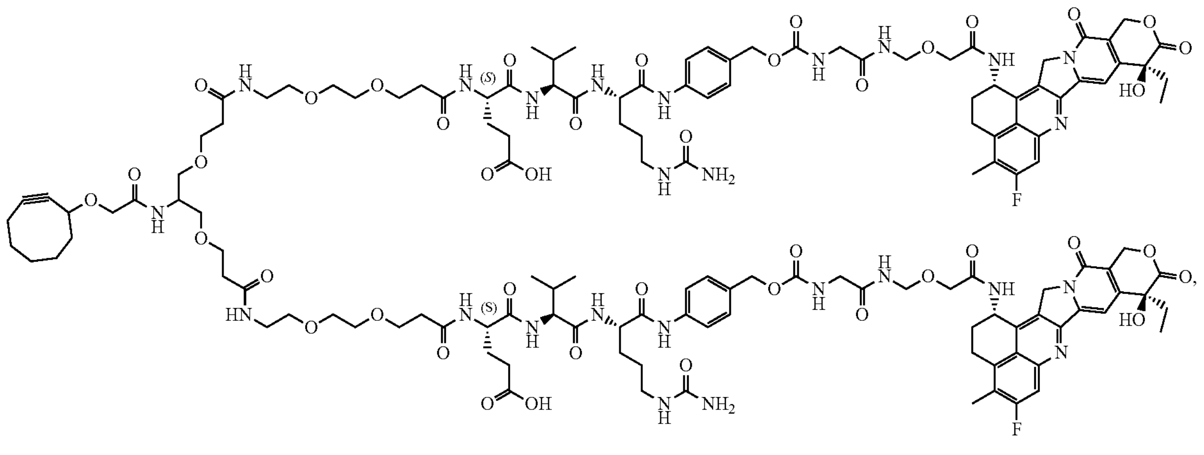
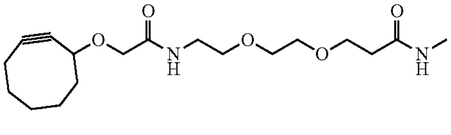

-continued
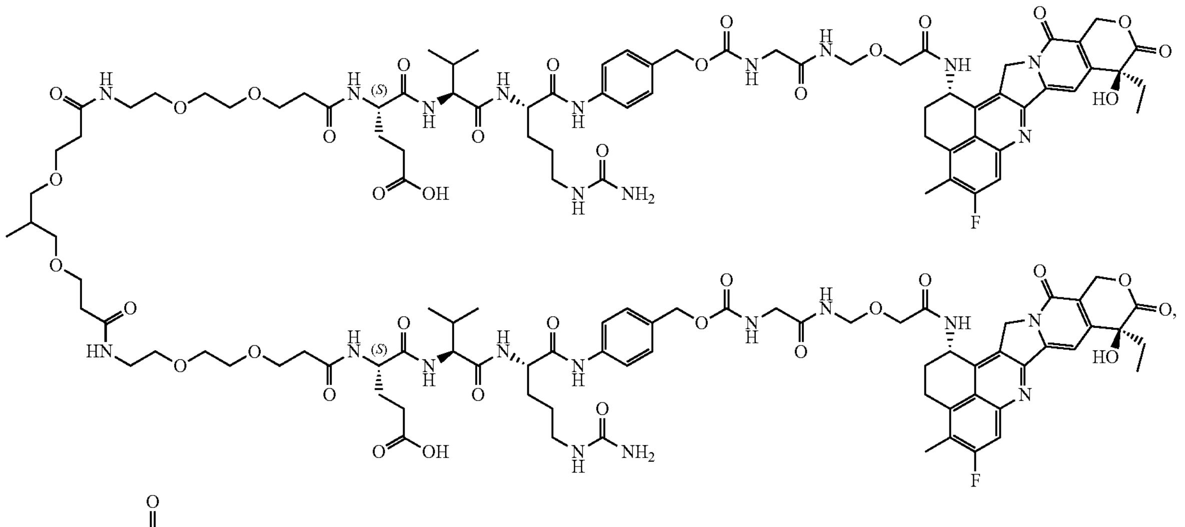
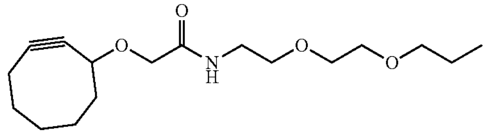
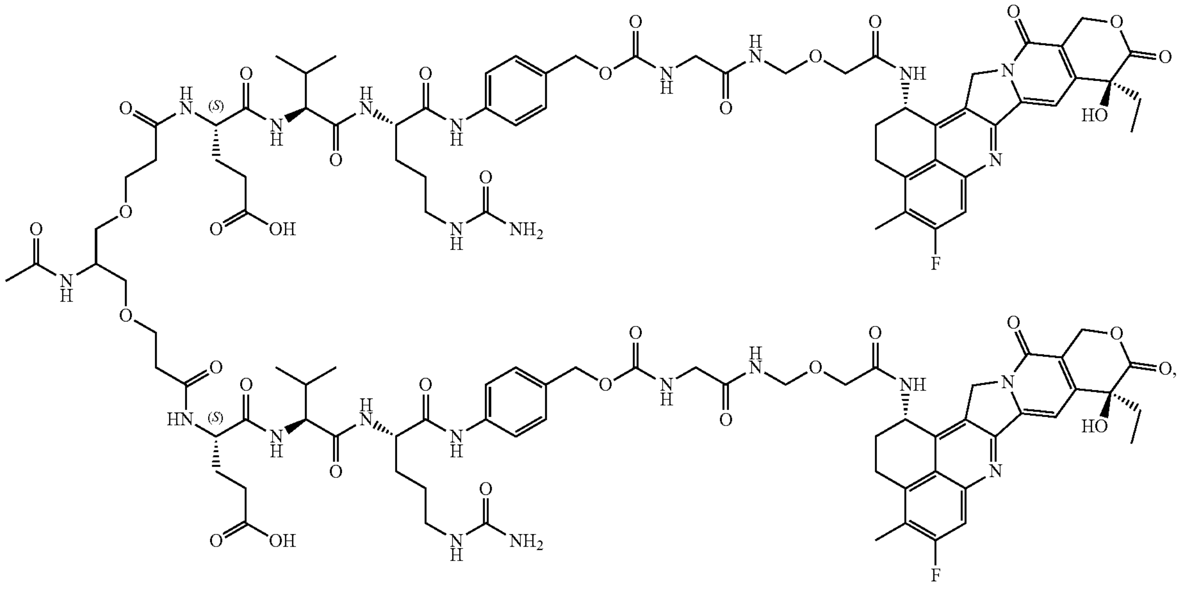
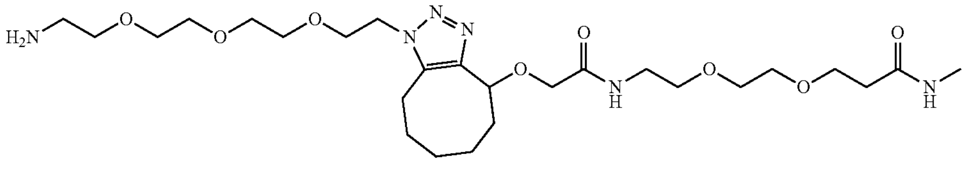

-continued
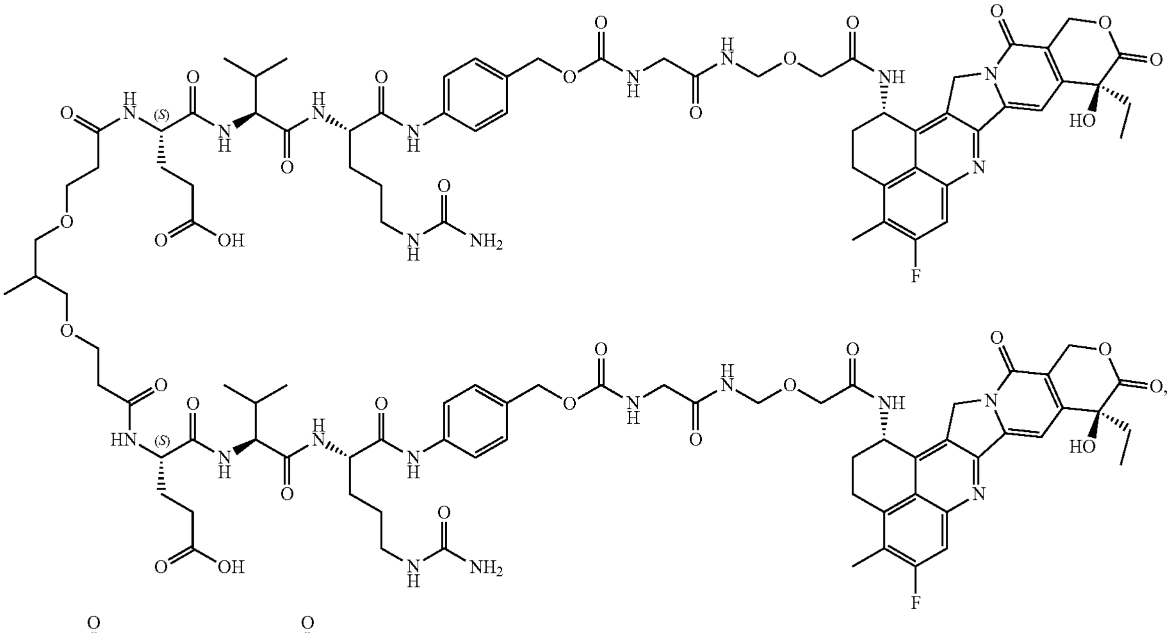
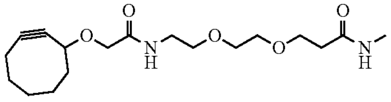
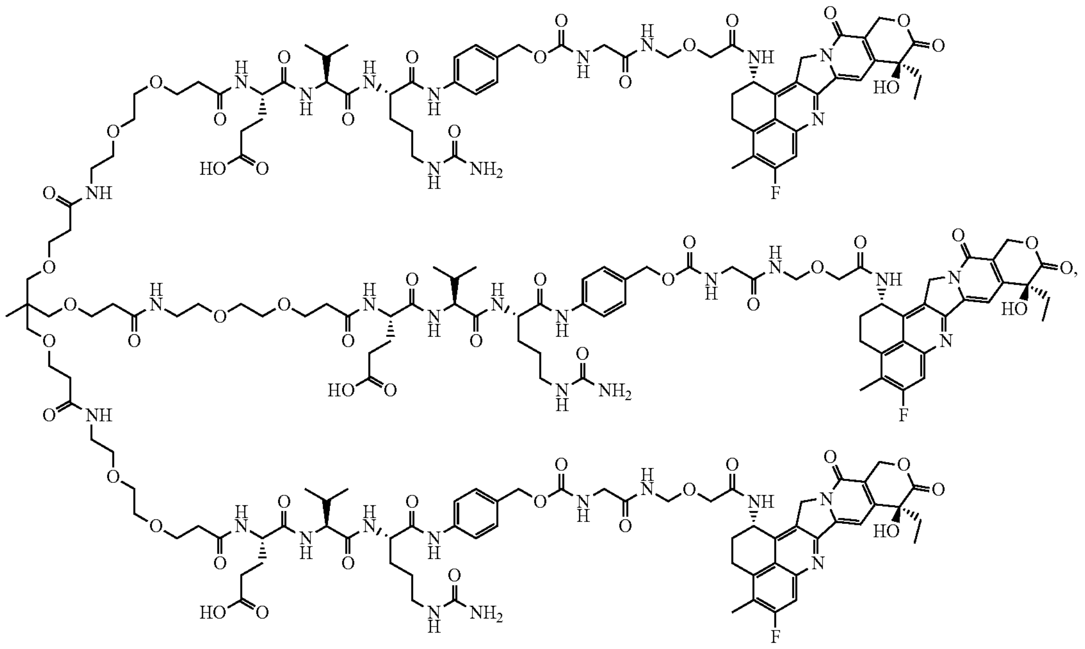
and
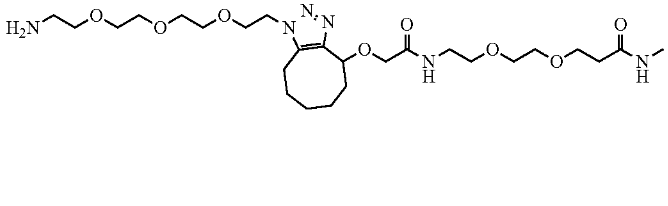

-continued

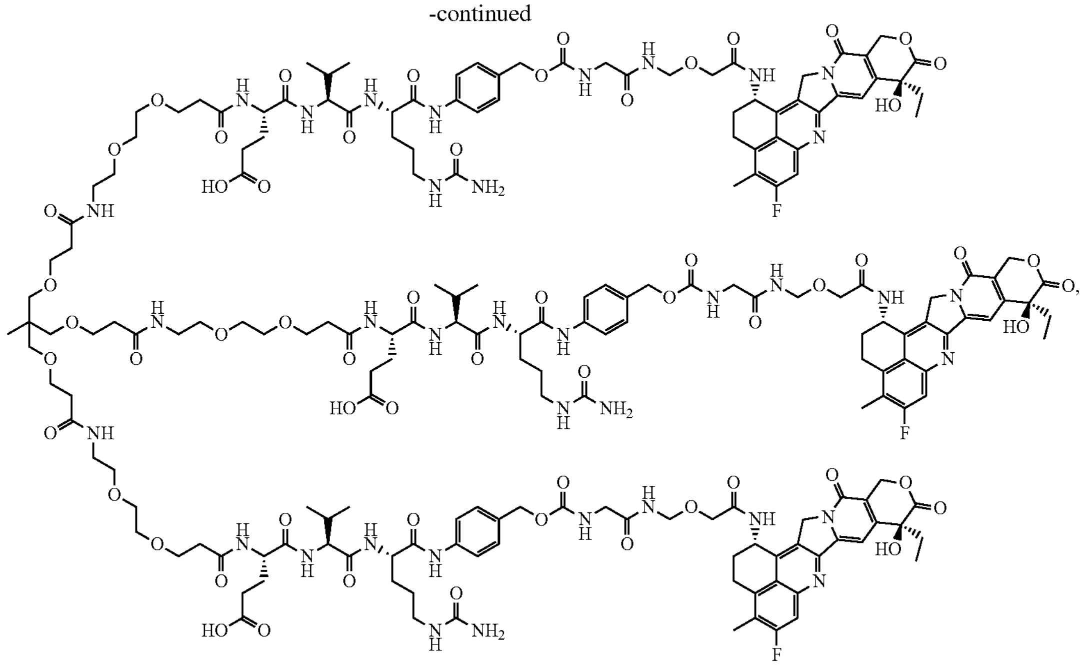

or a pharmaceutically acceptable salt thereof.

Therapeutic Formulation and Administration

The present disclosure provides pharmaceutical compositions comprising the protein-drug conjugates of the present disclosure.

In one aspect, the present disclosure provides compositions comprising a population of protein-drug conjugates according to the present disclosure having a drug-antibody ratio (OAR) of about 0.5 to about 30.0.

In one embodiment, the composition has a OAR of about 1.0 to about 2.5.

In one embodiment, the composition has a OAR of about 2.

In one embodiment, the composition has a OAR of about 3.0 to about 4.5.

In one embodiment, the composition has a OAR of about 4.

In one embodiment, the composition has a OAR of about 6.5 to about 8.5.

In one embodiment, the composition has a DAR of about 8.

In one embodiment, the composition has a DAR of about 10 to about 14.

In one embodiment, the composition has a DAR of about 12.

In one embodiment, the composition has a DAR of about 14 to about 18.

In one embodiment, the composition has a DAR of about 16.

In one embodiment, the composition has a DAR of about 20 to about 24.5.

In one embodiment, the composition has a DAR of about 24.

The compositions of the disclosure are formulated with suitable carriers, excipients, and other agents that provide improved transfer, delivery, tolerance, and the like. A multitude of appropriate formulations can be found in the formulary known to all pharmaceutical chemists: Remington's Pharmaceutical Sciences, Mack Publishing Company, Easton, PA. These formulations include, for example, powders, pastes, ointments, jellies, waxes, oils, lipids, lipid (cationic or anionic) containing vesicles (such as LIPOFECTIN™, Life Technologies, Carlsbad, CA), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of a protein-drug conjugate administered to a patient may vary depending upon the age and the size of the patient, target disease, conditions, route of administration, and the like. The suitable dose is typically calculated according to body weight or body surface area. When a protein-drug conjugate of the present disclosure is used for therapeutic purposes in an adult patient, it may be advantageous to intravenously administer the protein-drug conjugate of the present disclosure normally at a single dose of about 0.01 to about 20 mg/kg body weight, more preferably about 0.02 to about 7, about 0.03 to about 5, or about 0.05 to about 3 mg/kg body weight. Depending on the severity of the condition, the frequency and the duration of the treatment can be adjusted. Effective dosages and schedules for administering a protein-drug conjugate may be determined empirically; for example, patient progress can be monitored by periodic assessment, and the dose adjusted accordingly. Moreover, interspecies scaling of dosages can be performed using well-known methods in the art (e.g., Mordenti et al., 1991, Pharmaceut. Res. 8:1351).

Various delivery systems are known and can be used to administer the pharmaceutical composition of the disclosure, e.g., encapsulation in liposomes, microparticles, microcapsules, recombinant cells capable of expressing the mutant viruses, receptor mediated endocytosis (see, e.g., Wu et al., 1987, J. Biol. Chem. 262:4429-4432). Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

A pharmaceutical composition of the present disclosure can be delivered subcutaneously or intravenously with a standard needle and syringe. In addition, with respect to subcutaneous delivery, a pen delivery device readily has applications in delivering a pharmaceutical composition of the present disclosure. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present disclosure. Examples include, but are not limited to AUTOPEN™ (Owen Mumford, Inc., Woodstock, UK), DISETRONIC™ pen (Disetronic Medical Systems, Bergdorf, Switzerland), HUMALOG MIX 75/25™ pen, HUMALOG™ pen, HUMALIN 70/30™ pen (Eli Lilly and Co., Indianapolis, IN), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, NJ), OPTIPEN™ OPTIPEN PRO™, OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present disclosure include, but are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, CA), the PENLET™ (Haselmeier, Stuttgart, Germany), the EPIPEN (Dey, L. P.), and the HUMIRA™ Pen (Abbott Labs, Abbott Park IL), to name only a few.

In certain situations, the pharmaceutical composition can be delivered in a controlled release system. In one embodiment, a pump may be used (see Langer, supra; Sefton, 1987, CRC Crit. Ref. Biomed. Eng. 14:201). In another embodiment, polymeric materials can be used; see, Medical Applications of Controlled Release, Langer and Wise (eds.), 1974, CRC Pres., Boca Raton, Florida. In yet another embodiment, a controlled release system can be placed in proximity of the composition's target, thus requiring only a fraction of the systemic dose (see, e.g., Goodson, 1984, in Medical Applications of Controlled Release, supra, vol. 2, pp. 115-138). Other controlled release systems are discussed in the review by Langer, 1990, Science 249:1527-1533.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Therapeutic Uses of the Protein-Drug Conjugates, Linker-Payloads and Payloads

In another aspect, the protein-drug conjugates, e.g., ADCs, disclosed herein are useful, inter alia, for the treatment, prevention and/or amelioration of a disease, disorder or condition in need of such treatment.

In one embodiment, the present invention provides a method of treating a condition in a subject in need thereof comprising administering to the subject a therapeutically effective amount of a compound (e.g., an antibody-drug conjugate, a linker-payload and/or a payload) according to the disclosure, or the composition comprising any compound according to the present disclosure.

In one embodiment, the protein-drug conjugates, e.g., ADCs, disclosed herein are useful for treating cancer. In one embodiment, the protein-drug conjugates, e.g., ADCs, disclosed herein are useful for treating a cancer selected from the group consisting of breast cancer, ovarian cancer, prostate cancer, lung cancer, liver cancer, or brain cancer. In one embodiment, the protein-drug conjugates, e.g., ADCs, disclosed herein are useful for treating HER2+ breast cancer. In one embodiment, the protein-drug conjugates, e.g., ADCs, disclosed herein are useful for treating prostate cancer.

In one aspect, the present disclosure provides a method of selectively delivering a compound into a cell. In one embodiment, the method of selectively delivering a compound into a cell comprises linking the compound to a targeted antibody. In one embodiment, the compound is a payload as described above. In one embodiment, the cell is a mammalian cell. In one embodiment, the cell is a human cell. In one embodiment, the cell is a cancer cell. In one embodiment, the cancer cell is selected from the group consisting of a breast cancer cell, an ovarian cancer cell, a prostate cancer cell, a lung cancer cell, a liver cancer cell, or a brain cancer cell.

In certain embodiments, the present disclosure provides a method of selectively delivering into a cell a compound having the structure P-I:

(P-I)

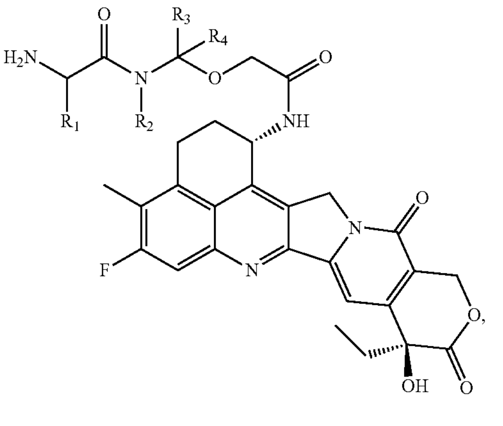

wherein $R_1$, $R_2$, and $R_3$, and $R_4$ are independently a hydrogen or an alkyl, e.g., a $C_1$-$C_{12}$ alkyl, or a $C_1$-$C_8$ alkyl, or a $C_1$-$C_6$ alkyl, or a $C_1$-$C_4$ alkyl, or wherein $R_2$ and $R_3$ together form a 5-membered or a 6-membered ring, or a pharmaceutically acceptable salt thereof.

In one aspect, the present disclosure provides a method of selectively targeting an antigen on a surface of a cell with a compound. In one embodiment, the method of selectively targeting an antigen on a surface of a cell with a compound comprises linking the compound to a targeted antibody. In one embodiment, the compound is a payload as described above. In one embodiment, the cell is a mammalian cell. In one embodiment, the cell is a human cell. In one embodiment, the cell is a cancer cell. In one embodiment, the cancer cell is selected from the group consisting of a breast cancer cell, an ovarian cancer cell, a prostate cancer cell, a lung cancer cell, a liver cancer cell, or a brain cancer cell.

In certain embodiments, the present disclosure provides a method of selectively targeting an antigen on a surface of a cell with a compound having the structure P-I:

(P-I)

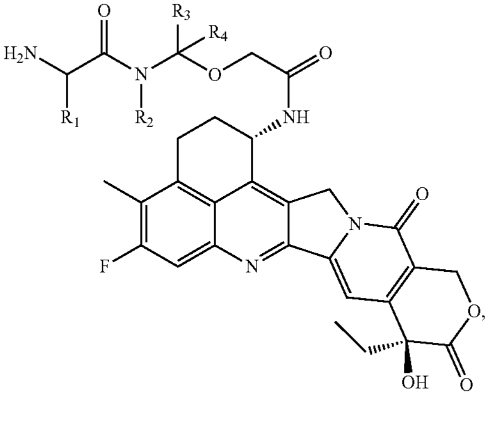

wherein $R_1$, $R_2$, and $R_3$, and $R_4$ are independently a hydrogen or an alkyl, e.g., a $C_1$-$C_{12}$ alkyl, or a $C_1$-$C_8$ alkyl, or a $C_1$-$C_6$ alkyl, or a $C_1$-$C_4$ alkyl, or wherein $R_2$ and $R_3$ together form a 5-membered or a 6-membered ring, or a pharmaceutically acceptable salt thereof.

Anti-HER2 Antibody-Drug Conjugates

In certain embodiments, the protein-drug conjugates, e.g., ADCs, disclosed herein are useful, inter alia, for the treatment, prevention and/or amelioration of any disease or disorder associated with or mediated by HER2 expression or activity, or treatable by binding HER2 without competing against modified LDL, or and/or promoting HER2 receptor internalization and/or decreasing cell surface receptor number.

The protein-drug conjugates of the present disclosure (and therapeutic compositions comprising the same) are useful, inter alia, for treating any disease or disorder in which stimulation, activation and/or targeting of an immune response would be beneficial. In particular, the anti-HER2 protein-drug conjugates, including both monospecific anti-HER2 antibodies and bispecific anti-HER2/HER2 antibodies of the present disclosure can be used for the treatment, prevention and/or amelioration of any disease or disorder associated with or mediated by HER2 expression or activity or the proliferation of HER2+ cells. The mechanism of action by which the therapeutic methods of the present disclosure are achieved include killing of the cells expressing HER2 in the presence of effector cells, for example, by CDC, apoptosis, ADCC, phagocytosis, or by a combination of two or more of these mechanisms, Cells expressing HER2 which can be inhibited or killed using the protein-drug conjugates of the present disclosure include, for example, breast tumor cells.

In one embodiment, the protein-drug conjugates of the present disclosure (and therapeutic compositions and dosage forms comprising same) comprise a bispecific antigen-binding molecule comprising:

a first antigen-binding domain (D1); and a second antigen-binding domain (D2);

wherein D1 specifically binds a first epitope of human HER2; and wherein D2 specifically binds a second epitope of human HER2.

In one embodiment of the above, D1 and D2 do not compete with one another for binding to human HER2.

The protein-drug conjugates of the present disclosure can be used to treat, e.g., primary and/or metastatic tumors arising in the prostate, bladder, cervix, lung, colon, kidney, breast, pancreas, stomach, uterus, and/or ovary. In certain embodiments, the protein-drug conjugates of the present disclosure are used to treat one or more of the following cancers: prostate cancer, bladder cancer, cervical cancer, lung cancer, colon cancer, kidney cancer, breast cancer, pancreatic cancer, stomach cancer, uterine cancer, and ovarian cancer. According to certain embodiments of the present disclosure, the anti-HER2 antibodies or anti-HER2/HER2 bispecific antibodies are useful for treating a patient afflicted with a breast cancer cell that is IHC2+ or more. According to other related embodiments of the present disclosure, methods are provided comprising administering an anti-HER2 antibody or an anti-HER2/HER2 antibody as disclosed herein to a patient who is afflicted with a breast cancer cell that is IHC2+ or more. Analytic/diagnostic methods known in the art, such as tumor scanning, etc., can be used to ascertain whether a patient harbors a tumor that is castrate-resistant.

In certain embodiments, the present disclosure also includes methods for treating residual cancer in a subject. The term “residual cancer” means the existence or persistence of one or more cancerous cells in a subject following treatment with an anti-cancer therapy.

The protein-drug conjugates of the present disclosure (and therapeutic compositions comprising the same) are useful, inter alia, for treating any disease or disorder in which stimulation, activation and/or targeting of an immune response would be beneficial. In particular, protein-drug conjugates comprising the anti-HER2 antibodies or anti HER2/HER2 antibodies of the present disclosure can be used for the treatment, prevention and/or amelioration of any disease or disorder associated with or mediated by HER2 expression or activity or the proliferation of HER2+ cells. The mechanism of action by which the therapeutic methods of the present disclosure are achieved include killing of the cells expressing HER2 in the presence of effector cells, for example, by CDC, apoptosis, ADCC, phagocytosis, or by a combination of two or more of these mechanisms. Cells expressing HER2 which can be inhibited or killed using the protein-drug conjugates of the present disclosure include, for example, breast tumor cells.

According to certain aspects, the present disclosure provides methods for treating a disease or disorder associated with HER2 expression (e.g., breast cancer) comprising administering one or more of the anti-HER2 protein-drug conjugates or anti-HER2/HER2 bispecific protein-drug conjugates described elsewhere herein to a subject after the subject has been determined to have breast cancer (e.g., and IHC2+ breast cancer). For example, the present disclosure includes methods for treating breast cancer comprising administering protein-drug conjugate comprising an anti-HER2 antibody or antigen-binding molecule or an anti-HER2/HER2 bispecific antibody or antigen-binding molecule to a patient 1 day, 2 days, 3 days, 4 days, 5 days, 6 days, 1 week, 2 weeks, 3 weeks or 4 weeks, 2 months, 4 months, 6 months, 8 months, 1 year, or more after the subject has received hormone therapy (e.g., anti-androgen therapy).

In certain embodiments, the present disclosure also includes the use of an anti-HER2 antibody of the present disclosure in the manufacture of a medicament for the treatment of a disease or disorder (e.g., cancer) related to or caused by HER2-expressing cells. In one aspect, the present disclosure relates to a protein-drug conjugate comprising an anti-HER2 antibody or antigen-binding fragment or an anti-HER2/HER2 bispecific antibody or antigen-binding fragment, as disclosed herein, for use in medicine. In one aspect, the present disclosure relates to a compound comprising an antibody-drug conjugate (ADC) as disclosed herein, for use in medicine.

Anti-STEAP2 Antibody-Drug Conjugates

In certain embodiments, the protein-drug conjugates, e.g., ADCs, disclosed herein are useful, inter alia, for the treatment, prevention and/or amelioration of any disease or disorder associated with or mediated by STEAP2 expression or activity, or treatable by binding STEAP2 without competing against modified LDL, or and/or promoting STEAP2 receptor internalization and/or decreasing cell surface receptor number.

The protein-drug conjugates of the present disclosure (and therapeutic compositions comprising the same) are useful, inter alia, for treating any disease or disorder in which stimulation, activation and/or targeting of an immune response would be beneficial. In particular, the anti-STEAP2 protein-drug conjugates of the present disclosure can be used for the treatment, prevention and/or amelioration of any disease or disorder associated with or mediated by STEAP2 expression or activity or the proliferation of STEAP2+ cells. The mechanism of action by which the therapeutic methods of the present disclosure are achieved include killing of the cells expressing STEAP2 in the presence of effector cells, for example, by CDC, apoptosis, ADCC, phagocytosis, or by a combination of two or more of these mechanisms, Cells expressing STEAP2 which can be inhibited or killed using the protein-drug conjugates of the present disclosure include, for example, prostate tumor cells.

The protein-drug conjugates of the present disclosure can be used to treat, e.g., primary and/or metastatic tumors arising in the prostate, bladder, cervix, lung, colon, kidney, breast, pancreas, stomach, uterus, and/or ovary. In certain embodiments, the protein-drug conjugates of the present disclosure are used to treat one or more of the following cancers: prostate cancer, bladder cancer, cervical cancer, lung cancer, colon cancer, kidney cancer, breast cancer, pancreatic cancer, stomach cancer, uterine cancer, and ovarian cancer. Analytic/diagnostic methods known in the art, such as tumor scanning, etc., can be used to ascertain whether a patient harbors a tumor that is castrate-resistant.

In certain embodiments, the present disclosure also includes methods for treating residual cancer in a subject. The term "residual cancer" means the existence or persistence of one or more cancerous cells in a subject following treatment with an anti-cancer therapy.

According to certain aspects, the present disclosure provides methods for treating a disease or disorder associated with STEAP2 expression (e.g., prostate cancer) comprising administering one or more of the anti-STEAP2 protein-drug conjugates described elsewhere herein to a subject after the subject has been determined to have prostate cancer. For example, the present disclosure includes methods for treating prostate cancer comprising administering protein-drug conjugate comprising an anti-STEAP2 antibody or antigen-binding molecule to a patient 1 day, 2 days, 3 days, 4 days, 5 days, 6 days, 1 week, 2 weeks, 3 weeks or 4 weeks, 2 months, 4 months, 6 months, 8 months, 1 year, or more after the subject has received hormone therapy (e.g., anti-androgen therapy).

In certain embodiments, the present disclosure also includes the use of an anti-STEAP2 antibody of the present disclosure in the manufacture of a medicament for the treatment of a disease or disorder (e.g., cancer) related to or caused by STEAP2-expressing cells. In one aspect, the present disclosure relates to a protein-drug conjugate comprising an anti-STEAP2 antibody or antigen-binding fragment, as disclosed herein, for use in medicine. In one aspect, the present disclosure relates to a compound comprising an antibody-drug conjugate (ADC) as disclosed herein, for use in medicine.

Anti-MET Antibody-Drug Conjugates

In certain embodiments, the protein-drug conjugates, e.g., ADCs, disclosed herein are useful, inter alia, for the treatment, prevention and/or amelioration of any disease or disorder associated with or mediated by MET expression or activity, or treatable by binding MET without competing against modified LDL, or and/or promoting MET receptor internalization and/or decreasing cell surface receptor number.

The protein-drug conjugates of the present disclosure (and therapeutic compositions comprising the same) are useful, inter alia, for treating any disease or disorder in which stimulation, activation and/or targeting of an immune response would be beneficial. In particular, the anti-MET or anti MET/MET bispecific protein-drug conjugates of the present disclosure can be used for the treatment, prevention and/or amelioration of any disease or disorder associated with or mediated by MET expression or activity or the proliferation of MET+ cells. The mechanism of action by which the therapeutic methods of the present disclosure are achieved include killing of the cells expressing MET in the presence of effector cells, for example, by CDC, apoptosis, ADCC, phagocytosis, or by a combination of two or more of these mechanisms. Cells expressing MET which can be inhibited or killed using the protein-drug conjugates of the present disclosure include, for example, lung tumor cells.

The protein-drug conjugates of the present disclosure can be used to treat, e.g., primary and/or metastatic tumors arising in the prostate, bladder, cervix, lung, colon, kidney, breast, pancreas, stomach, uterus, and/or ovary. In certain embodiments, the protein-drug conjugates of the present disclosure are used to treat one or more of the following cancers: prostate cancer, bladder cancer, cervical cancer, lung cancer, colon cancer, kidney cancer, breast cancer, pancreatic cancer, stomach cancer, uterine cancer, and ovarian cancer. Analytic/diagnostic methods known in the art, such as tumor scanning, etc., can be used to ascertain whether a patient harbors a tumor that is castrate-resistant.

In certain embodiments, the present disclosure also includes methods for treating residual cancer in a subject. The term "residual cancer" means the existence or persistence of one or more cancerous cells in a subject following treatment with an anti-cancer therapy.

According to certain aspects, the present disclosure provides methods for treating a disease or disorder associated with MET expression (e.g., lung cancer) comprising administering one or more of the anti-MET or anti MET/MET bispecific protein-drug conjugates described elsewhere herein to a subject after the subject has been determined to have lung cancer. For example, the present disclosure includes methods for treating lung cancer comprising administering protein-drug conjugate comprising an anti-MET or anti MET/MET bispecific antibody or antigen-binding molecule to a patient 1 day, 2 days, 3 days, 4 days, 5 days, 6 days, 1 week, 2 weeks, 3 weeks or 4 weeks, 2 months, 4 months, 6 months, 8 months, 1 year, or more after the subject has received hormone therapy (e.g., anti-androgen therapy).

For example, anti-MET antibody-drug conjugates and MET×MET bispecific antibody-drug conjugates of the present disclosure are useful for the treatment of tumors that express (or overexpress) MET. For example, the anti-MET antibody-drug conjugates and MET×MET bispecific antibody-drug conjugates may be used to treat primary and/or metastatic tumors arising in the brain and meninges, oropharynx, lung and bronchial tree, gastrointestinal tract, male and female reproductive tract, muscle, bone, skin and appendages, connective tissue, spleen, immune system, blood forming cells and bone marrow, liver and urinary tract, and special sensory organs such as the eye. In certain embodiments, the anti-MET antibody-drug conjugates and MET×MET bispecific antibody-drug conjugates are used to treat one or more of the following cancers: acute myelogenous leukemia, adult T-cell leukemia, astrocytomas, bladder cancer, breast cancer, cervical cancer, cholangiocarcinoma, chronic myeloid leukemia, colorectal cancer, endometrial cancer, esophageal cancer, gastric cancer (e.g., gastric cancer with MET amplification), glioblastomata, head and neck cancer (e.g., head and neck squamous cell carcinoma [HNSCC]), Kaposi's sarcoma, kidney cancer, leiomyosarcomas, liver cancer, lung cancer (e.g., non-small cell lung cancer [NSCLC]), lymphomas, malignant gliomas, malignant mesothelioma, melanoma, mesothelioma, MFH/fibrosarcoma, multiple myeloma, nasopharyngeal cancer, osteosarcoma, ovarian cancer, pancreatic carcinoma, prostate cancer, renal cell carcinoma, rhabdomyosarcoma, small cell lung cancer, synovial sarcoma, thyroid cancer, and Wilms' tumor.

In certain embodiments, the present disclosure also includes the use of an anti-MET antibody-drug conjugate or a MET×MET bispecific antibody-drug conjugate of the present disclosure in the manufacture of a medicament for the treatment of a disease or disorder (e.g., cancer) related to or caused by MET-expressing cells. In one aspect, the present disclosure relates to a protein-drug conjugate comprising an anti-MET antibody-drug conjugate or a MET×MET bispecific antibody-drug conjugate, as disclosed herein, for use in medicine. In one aspect, the present disclosure relates to a compound comprising an antibody-drug conjugate (ADC) as disclosed herein, for use in medicine.

Combination Therapies and Formulations

The present disclosure provides methods which comprise administering a pharmaceutical composition comprising any of the exemplary protein-drug conjugates (e.g., antibody-drug conjugates), linker-payloads and payloads described herein in combination with one or more additional therapeutic agents. Exemplary additional therapeutic agents that may be combined with or administered in combination with protein-drug conjugates (e.g., antibody-drug conjugates), linker-payloads and payloads of the present disclosure include, e.g., a HER2 antagonist (e.g., an anti-HER2 antibody [e.g., trastuzumab] or a small molecule inhibitor of HER2 or an anti-HER2 antibody-drug conjugate, or an anti-HER2/HER2 bispecific antibody or an anti-HER2/HER2 bispecific antibody-drug conjugate), an EGFR antagonist (e.g., an anti-EGFR antibody [e.g., cetuximab or panitumumab] or small molecule inhibitor of EGFR [e.g., gefitinib or erlotinib]), an antagonist of another EGFR family member such as HER2/ErbB2, ErbB3 or ErbB4 (e.g., anti-ErbB2, anti-ErbB3 or anti-ErbB4 antibody or small molecule inhibitor of ErbB2, ErbB3 or ErbB4 activity), an antagonist of EGFRvIII (e.g., an antibody that specifically binds EGFRvIII), a cMET antagonist (e.g., an anti-cMET antibody), an IGF1R antagonist (e.g., an anti-IGF1R antibody), a B-raf inhibitor (e.g., vemurafenib, sorafenib, gDC-0879, PLX-4720), a PDGFR-α inhibitor (e.g., an anti-PDGFR-α antibody), a PDGFR-β inhibitor (e.g., an anti-PDGFR-β antibody), a VEGF antagonist (e.g., a VEGF-Trap, see, e.g., U.S. Pat. No. 7,087,411 (also referred to herein as a "VEGF-inhibiting fusion protein"), anti-VEGF antibody (e.g., bevacizumab), a small molecule kinase inhibitor of VEGF receptor (e.g., sunitinib, sorafenib or pazopanib)), a DLL4 antagonist (e.g., an anti-DLL4 antibody disclosed in US 2009/0142354), an Ang2 antagonist (e.g., an anti-Ang2 antibody disclosed in US 2011/0027286 such as H1H685P), a FOLH1 (PSMA) antagonist, a PRLR antagonist (e.g., an anti-PRLR antibody), a STEAP1 or STEAP2 antagonist (e.g., an anti-STEAP1 antibody or an anti-STEAP2 antibody), a TMPRSS2 antagonist (e.g., an anti-TMPRSS2 antibody), a MSLN antagonist (e.g., an anti-MSLN antibody), a CA9 antagonist (e.g., an anti-CA9 antibody), a uroplakin antagonist (e.g., an anti-uroplakin antibody), etc.

Other agents that may be beneficially administered in combination with the protein-drug conjugates (e.g., antibody-drug conjugates), linker-payloads and payloads of the disclosure include cytokine inhibitors, including small-molecule cytokine inhibitors and antibodies that bind to cytokines such as IL-1, IL-2, IL-3, IL-4, IL-5, IL-6, IL-8, IL-9, IL-11, IL-12, IL-13, IL-17, IL-18, or to their respective receptors. The pharmaceutical compositions of the present disclosure (e.g., pharmaceutical compositions comprising an anti-HER2, an anti-HER2/HER2 bispecific, an anti-MET, an anti-MET/MET bispecific, or an anti-STEAP2 protein-drug conjugate (e.g., antibody-drug conjugate as disclosed herein) may also be administered as part of a therapeutic regimen comprising one or more therapeutic combinations selected from "ICE": ifosfamide (e.g., Ifex®), carboplatin (e.g., Paraplatin®), etoposide (e.g., Etopophos®, Toposar®, VePesid®, VP-16); "DHAP": dexamethasone (e.g., Decadron®), cytarabine (e.g., Cytosar-U®, cytosine arabinoside, ara-C), cisplatin (e.g., Platinol®-AQ); and "ESHAP": etoposide (e.g., Etopophos®, Toposar®, VePesid®, VP-16), methylprednisolone (e.g., Medrol®), high-dose cytarabine, cisplatin (e.g., Platinol®-AQ).

The present disclosure also includes therapeutic combinations comprising any of the protein-drug conjugates (e.g., antibody-drug conjugates), linker-payloads and payloads mentioned herein and an inhibitor of one or more of HER2, VEGF, Ang2, DLL4, EGFR, ErbB2, ErbB3, ErbB4, EGFRvIII, cMet, IGF1R, B-raf, PDGFR-α, PDGFR-β, FOLH1 (PSMA), PRLR, STEAP1, STEAP2, TMPRSS2, MSLN, CA9, uroplakin, or any of the aforementioned cytokines, wherein the inhibitor is an aptamer, an antisense molecule, a ribozyme, an siRNA, a peptibody, a nanobody or an antibody fragment (e.g., Fab fragment; F(ab')2 fragment; Fd fragment; Fv fragment; scFv; dAb fragment; or other engineered molecules, such as diabodies, triabodies, tetrabodies, minibodies and minimal recognition units). The antigen-binding molecules of the disclosure may also be administered and/or co-formulated in combination with antivirals, antibiotics, analgesics, corticosteroids and/or NSAIDs. The antigen-binding molecules of the disclosure may also be administered as part of a treatment regimen that also includes radiation treatment and/or conventional chemotherapy.

The additional therapeutically active component(s) may be administered just prior to, concurrent with, or shortly after the administration of an antigen-binding molecule of the present disclosure; (for purposes of the present disclosure, such administration regimens are considered the administration of an antigen-binding molecule "in combination with" an additional therapeutically active component).

The present disclosure includes pharmaceutical compositions in which protein-drug conjugates (e.g., antibody-drug conjugates), linker-payloads and/or payloads of the present disclosure are co-formulated with one or more of the additional therapeutically active component(s) as described elsewhere herein.

Administration Regimens

According to certain embodiments of the present disclosure, multiple doses of a protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or a payload may be administered to a subject over a defined time course. The methods according to this aspect of the disclosure comprise sequentially administering to a subject multiple doses of a protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or a payload of the disclosure. As used herein, "sequentially administering" means that each dose of a protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or a payload is administered to the subject at a different point in time, e.g., on different days separated by a predetermined interval (e.g., hours, days, weeks or months). The present disclosure includes methods which comprise sequentially administering to the patient a single initial dose of a protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or a payload, followed by one or more secondary doses of the protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or payload, and optionally followed by one or more tertiary doses of the a protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or payload.

The terms "initial dose," "secondary doses," and "tertiary doses," refer to the temporal sequence of administration of the protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or payload of the disclosure. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of the protein-drug conjugate (e.g., an anti-HER2, or an anti-HER2/HER2 bispecific, an anti-MET, an anti-MET/MET bispecific, or an anti-STEAP2 antibody-drug conjugate), linker-payload and/or payload, but generally may differ from one another in terms of frequency of administration. In certain embodiments, however, the amount of the protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or payload contained in the initial, secondary and/or tertiary doses varies from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present disclosure, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of a protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or payload which is administered to a patient prior to the administration of the very next dose in the sequence with no intervening doses.

The methods according to this aspect of the disclosure may comprise administering to a patient any number of secondary and/or tertiary doses of a protein-drug conjugate (e.g., an anti-HER2, an anti-HER2/HER2 bispecific, an anti-MET, an anti-MET/MET bispecific, or an anti-STEAP2 antibody-drug conjugate), linker-payload and/or payload. For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

EXAMPLES

The following examples illustrate specific aspects of the instant description. The examples should not be construed as limiting, as the examples merely provide specific understanding and practice of the embodiments and their various aspects.

Abbreviations

| | |
|---|---|
| ADC | Antibody-drug conjugate |
| Aglycosylated antibody | Antibody does not have any glycan |
| aq. | Aqueous |
| Boc | N-tert-butoxycarbonyl |
| BupH | Thermo Scientific Prod# 28372, containing 100 mM sodium phosphate and 150 mM sodium chloride, potassium free, pH was adjusted from 7.2 to 7.6-7.8 MQ, unless otherwise noted. |
| COT | Cyclooctynol |
| Da | Dalton |
| DAR | Drug to antibody ratio |
| DCM | Dichloromethane |
| DIBAC | Dibenz[b,f]azocine,11,12-didehydro-5,6-dihydro- |
| DIBAC-Suc | Dibenz[b,f]azocine-5(6H)-butanoic acid, 11,12-didehydro |
| DIBACT | 3H-Benzo[c]-1,2,3-triazolo[4,5-e][1]benzazocine,8,9-dihydro- |
| DIPEA | Diisopropylethylamine |

-continued

| | |
|---|---|
| DMF | N,N-dimethylformamide |
| DMSO | Dimethylsulfoxide |
| ELSD | Evaporating light scattering detector |
| Equiv. | Equivalent |
| ESI | Electrospray ionization |
| g | Gram |
| GUL-azide | (((S)-5-(4-azidobutanamido)-1-carboxypentyl)carbamoyl)-L-glutamic acid |
| HATU | 2-(7-Aza-1H-benzotriazole-1-yl)-1,1,3,3-tetramethyluronium hexafluorophosphate |
| HC | Heavy chain of immunoglobulin |
| HEK | Human embryonic kidney (cells) |
| HPLC | High performance liquid chromatography |
| hr or hrs | Hours |
| LC | Light chain of immunoglobulin |
| LC | Liquid chromatography |
| mg | milligrams |
| min | minutes |
| mL | milliliters |
| μL | microliters |
| mM | millimolar |
| μM | micromolar |
| MS | Mass spectrometry |
| MSD | Mass-selective detector |
| MW | Molecular weight |
| NHS | N-hydroxy succinimide |
| nM | nanomolar |
| NMR | Nuclear magnetic resonance |
| PAB | Para-aminobezyloxy(carbonyl) |
| PBS | 10 mM sodium phosphate buffer and 150 mM sodium chloride |
| PBSg | 10 mM phosphate, 150 mM sodium chloride, 5% glycerol |
| PEG | Polyethyleneglycol |
| ppm | Parts per million (chemical shift) |
| PPTS | pyridinium p-toluenesulfonate |
| RP | Reversed phase |
| RT | room temperature |
| Sat. | Saturated |
| SEC | Size exclusion chromatography |
| Suc | Succinic acid |
| MTBE | Tert-Butyl methyl ether |
| TEA | Triethylamine |
| TFA | Trifluoroacetic acid |
| TG | Transglutaminase |
| THF | Tetrahydrofuran |

Most starting materials were commercially available from Sigma-Aldrich®, J&K®, ChemExpress®, etc. The following compounds were synthesized according to corresponding references.

| Cpd# | Structure | CAS | Ref. |
|---|---|---|---|
| LP1-1 | 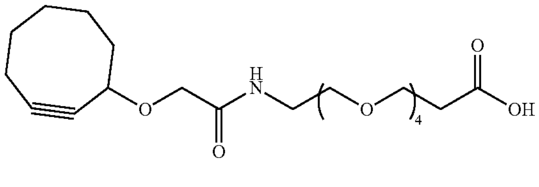 | 2226472-26-8 | WO2018089373 |
| LP2-1 | 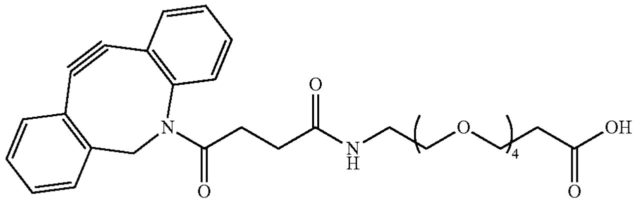 | 1537170-85-6 | WO2018089373 |
| LP2-2 | 219 | 2226472-27-9 | WO2018089373 |

-continued
| Cpd# | Structure | CAS | Ref. |
|---|---|---|---|
| LP2-3 | 220 | 2226472-28-0 | WO2018089373 |
General Methods
Example 1: Synthesis of Camptothecin Derivatives (Payloads)
TABLE 5
Exemplary camptothecin analog payloads P1-P4 according to the disclosure
| # | Name | Structures | cLogP | MF | MW | Purity (%) | m/z | Salt |
|---|---|---|---|---|---|---|---|---|
| P1 | Exatecan | 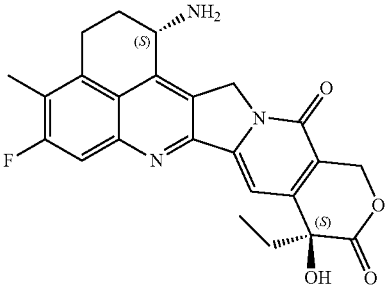 | 1.45 | $C_{24}H_{22}FN_3O_4$•$CH_4O_3S$ | 531.56 | 97 | 436.1 [M + H], 893.2 [2M + Na] | MsOH |
| P2 | Dxd | 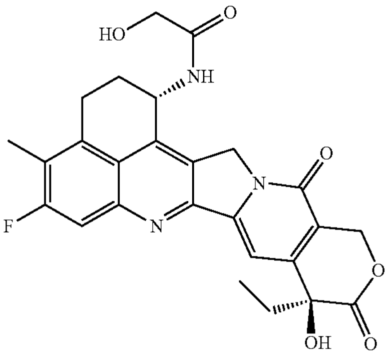 [SMILES: CC[C@@]1(O)C(=O)OCc2c1cc1n(c2=O)Cc2c-1nc1cc(F)c(C)c3c1c2[C@@H](NC(=O)CO)CC3] | 0.55 | $C_{26}H_{24}FN_3O_6$ | 493.48 | 100 | 494.2 [M + H] | NA |
| P3 | | 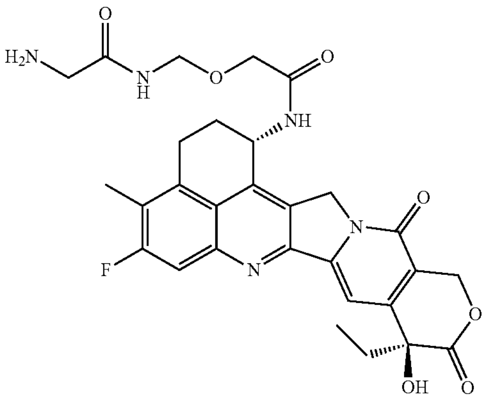 [SMILES: CC[C@@]1(O)C(=O)OCc2c1cc1n(c2=O)Cc2c-1nc1cc(F)c(C)c3c1c2[C@@H](NC(=O)COCNC(=O)CN)CC3] | −0.60 | $C_{29}H_{30}FN_5O_7$•$C_2HF_3O_2$ | 693.59 | 97 | 580.2 [M + H], 1159.2 [2M + H] | TFA |

TABLE 5-continued

Exemplary camptothecin analog payloads P1-P4 according to the disclosure

| # | Name | Structures | cLogP | MF | MW | Purity (%) | m/z | Salt |
|---|---|---|---|---|---|---|---|---|
| P4 | | 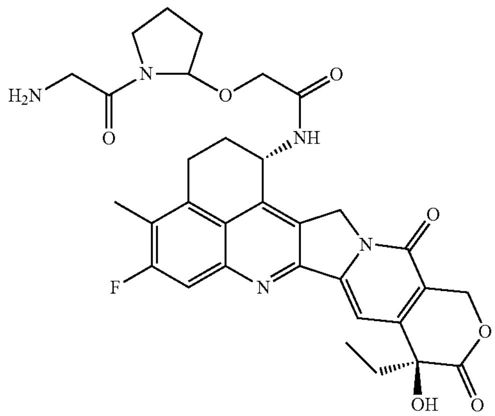 [SMILES: CC[C@@]1(O)C(=O)OCc2c1cc1n(c2=O)Cc2c-1nc1cc(F)c(C)c3c1c2[C@@H](NC(=O)COC1CCCN1C(=O)CN)CC3] | 0.02 | $C_{32}H_{34}FN_5O_7$ | 619.64 | 88 | 620.3 [M + H] | NA |

Payload P1, Exatecan mesylate, was commercially obtained from MCE. Payloads P2 and P3 were synthesized as described in WO2015155998, incorporated herein by reference, and camptothecin derivative payload P4 was synthesized as described in Scheme 1A and according to the synthetic steps outlined in Examples 1A-1E:

Scheme 1: Synthesis of Camptothecin derivatives (payloads) P3 and P4

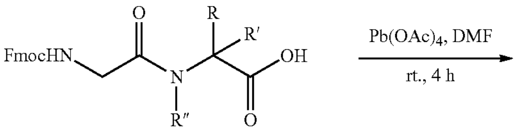

P3-1, R = R' = R'' = H

P4-1, R = H; R', R'' = $-(CH_2)_3-$

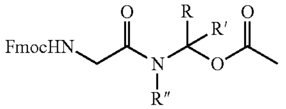

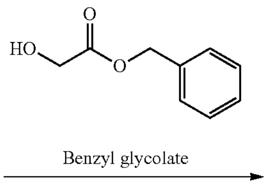

for R = R' = R'' = H:
benzyl glycolate,
PPTS, DCM, 50° C., 18 h
for R = H; R',R'' =
$-(CH_2)_3-$:
1) TMSCl, DCM, rt., 3 h
2) Benzyl glycolate, rt., 1 h

P3-2, R = R' = R'' = H

P4-2, R = H; R', R'' = $-(CH_2)_3-$

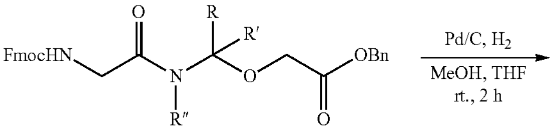

P3-3, R = R' = R'' = H

P4-3, R = H; R', R'' = $-(CH_2)_3-$

-continued

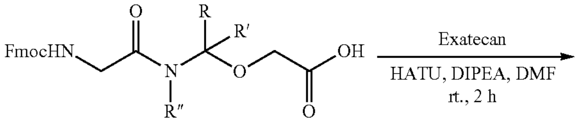

P3-4, R = R' = R'' = H

P4-4, R = H; R', R'' = $-(CH_2)_3-$

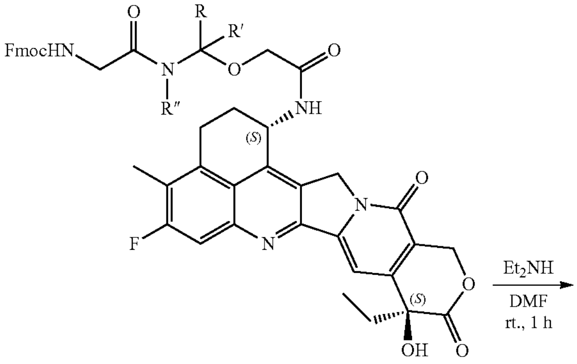

P3-5, R = R' = R'' = H

P4-5, R = H; R', R'' = $-(CH_2)_3-$

-continued

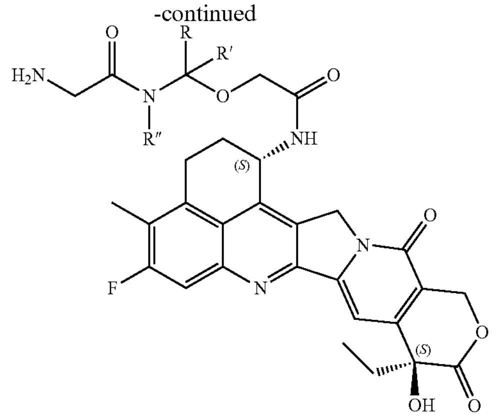

P3, P4

P3, R = R' = R'' = H

P4, R = H; R', R'' = $-(CH_2)_3-$

Example 1A: Synthesis of 9H-Fluoren-9-ylmethyl N-[2-(2-hydroxypyrrolidin-1-yl)-2-oxoethyl]carbamate (P4-2)

(P4-2)

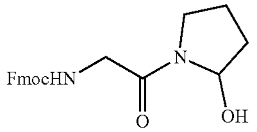

To a mixture of Fmoc-Gly-Pro-OH P4-1 (0.10 g, 0.26 mmol) in dry DMF (1 mL) was added lead tetraacetate (0.14 g, 0.31 mmol). The resulting mixture was stirred at RT for 30 minutes; reaction progress was monitored by LCMS. The resulting mixture was filtered through Celite, and the filtrate was diluted with ethyl acetate, washed with water and brine, dried over anhydrous sodium sulfate, and concentrated in vacuo. The residue was purified by silica gel column chromatography (0-10% ethyl acetate in petroleum ether) to give compound P4-2 (50 mg, 53% yield) as a white solid, and no acetate intermediate was obtained. ESI m/z: 389 $(M+23)^+$. $^1$H NMR (400 MHz, DMSO) δ7.90 (d, J=7.4 Hz, 2H), 7.73 (d, J=7.5 Hz, 2H), 7.47-7.37 (m, 3H), 7.33 (t, J=7.3 Hz, 2H), 5.86 (br s, 1H), 5.48 (d, J=4.0 Hz, 0.25H), 5.39 (d, J=4.0 Hz, 0.75H), 4.33-4.18 (m, 3H), 3.96 (d, J=6.0 Hz, 1.5H), 3.75 (d, J=6.0 Hz, 0.5H), 3.59-3.33 (m, 1H), 3.22-3.11 (m, 1H), 2.00-1.59 (m, 4H) ppm.

Example 1B: Synthesis of Benzyl 2-{[1-(2-{[(9H-fluoren-9-ylmethoxy)carbonyl]amino}acetyl) pyrrolidin-2-yl]oxy}acetate (P4-3)

(P4-3)

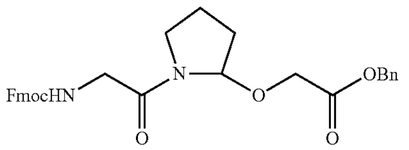

To a solution of compound P4-2 (0.30 g, 0.82 mmol) in DCM (25 mL) was added chlorotrimethylsilane (TMSCl) (0.27 g, 2.5 mmol). The reaction mixture was stirred at RT for 3 hours; reaction progress was monitored by LCMS. The resulting mixture was concentrated in vacuo and the residue was diluted with DCM (25 mL). To the solution were added benzyl glycolate (0.27 g, 1.6 mmol) and DIPEA (0.21 g, 1.6 mmol), and the reaction mixture was stirred at RT for an hour; the completion of the reaction was monitored by LCMS. The resulting mixture was concentrated in vacuo and the residue was purified by reversed phase flash chromatography (0-100% acetonitrile in aq. ammonium bicarbonate (0.05%)) to give compound P4-3 (0.11 g, 25% yield, with purity >99% and 50 mg, with purity 75%) as a white solid. ESI m/z: 537.3 $(M+Na)^+$. $^1$H NMR (400 MHz, $DMSO_{d6}$) δ 7.91-7.89 (m, 2H), 7.74-7.69 (m, 2H), 7.63-7.48 (m, 1H), 7.42-7.25 (m, 9H), 5.51-5.09 (m, 2H), 4.35-4.21 (m, 5H), 4.00-3.77 (m, 2H), 3.52-3.38 (m, 2H), 3.30-3.18 (m, 1H), 2.19-1.64 (m, 4H) ppm.

Example 1C: Synthesis of 2-{[1-(2-{[(9H-Fluoren-9-ylmethoxy)carbonyl]amino}acetyl)pyrrolidin-2-yl] oxy}acetic Acid (P4-4)

(P4-4)

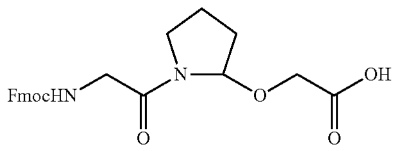

To a solution of compound P4-3 (89 mg, 0.17 mmol) in methanol (3 mL) and THF (7 mL) was added wet palladium on carbon (10% Pd, 20 mg) under nitrogen protection. The mixture was degassed and stirred under hydrogen balloon pressure at RT for 2 hours, and the completion of the reaction was monitored by LCMS. The reaction mixture was filtered through Celite and the filtrate was concentrated in vacuo. The residue was purified by reversed phase flash chromatography (0-100% acetonitrile in aq. ammonium bicarbonate (0.05%)) to give compound P4-4 (36 mg, 49% yield) as a white solid. ESI m/z: 447.1 $(M+Na)^+$.

Example 1D: 9H-Fluoren-9-ylmethyl N-{2-[2-({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)pyrrolidin-1-yl]-2-oxoethyl}carbamate (P4-5)

(P4-5)

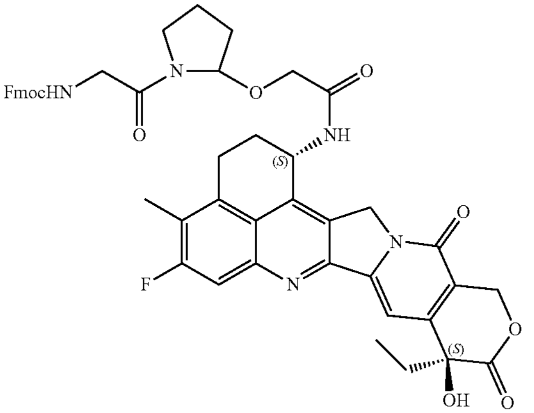

To a mixture of compound P4-4 (63 mg, 0.15 mmol) and Exatecan mesylate (66 mg, 0.12 mmol) in DMF (2 mL) were added HATU (61 mg, 0.16 mmol) and DIPEA (46 mg, 0.36 mmol), and the mixture was stirred at RT for 2 hours; reaction completion was monitored by LCMS. The reaction mixture was directly purified by reversed phase flash chromatography (0-100% acetonitrile in aq. ammonium bicarbonate (10 mM)) to give compound P4-5 (45 mg, 44% yield) as a yellow solid. ESI m/z: 842.3 $(M+H)^+$.

Example 1E: 2-{[1-(2-Aminoacetyl)pyrrolidin-2-yl]oxy}-N-[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]acetamide (P4)

(P4)

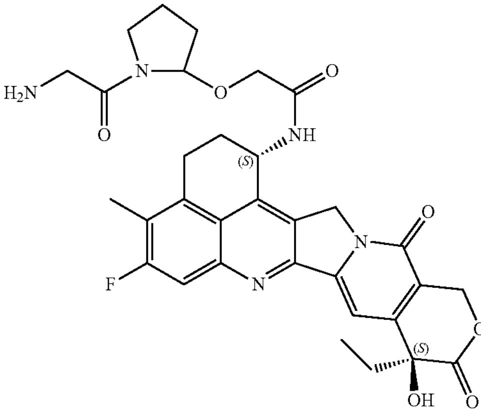

To a solution of compound P4-5 (45 mg, 54 μmol) in DCM (4 mL) was added diethylamine (20 mg, 0.27 mmol), and the mixture was stirred at RT overnight. Reaction completion was monitored by LCMS. The reaction mixture was concentrated in vacuo and the residue was purified by silica gel flash chromatography (0-10% methanol in DCM) to give compound P4 (9.5 mg, 28% yield) as colorless oil. ESI m/z: 620.3 $(M+H)^+$. Table 6, below, provides cytotoxicity and ADME (absorption, distribution, metabolism, and excretion) data for payloads P1-P3 according to the disclosure.

TABLE 6

Cytotoxicity and ADME results of Payloads.

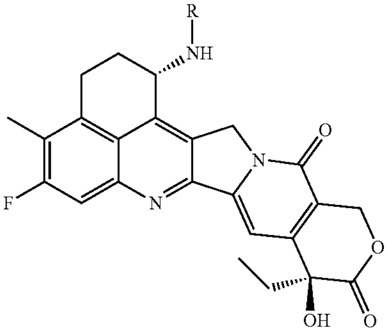

| # | Ref# | Structures R | HCT-15 $IC_{50}$ (nM) −v | HCT-15 Ratio to MMAE −v | HCT-15 $IC_{50}$ (nM) +v | HCT-15 Ratio to MMAE +v |
|---|---|---|---|---|---|---|
| | MMAE | | 14.810 | 1x | 0.946 | 1x |
| P1 | Exatecan | H | 1.292 | 0.087x | 1.734 | 1.833x |
| P2 | Dxd | $COCH_2OH$ | 6.995 | 0.472x | 2.654 | 2.805x |

TABLE 6-continued

Cytotoxicity and ADME results of Payloads.

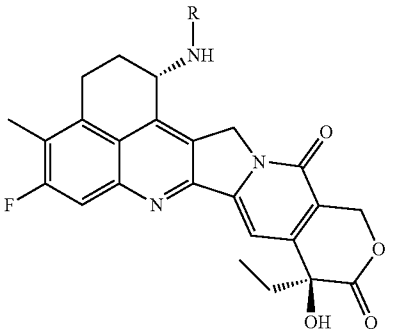

| # | Ref# | Structures R | HCT-15 IC$_{50}$ (nM) −v | Ratio to MMAE −v | IC$_{50}$ (nM) +v | Ratio to MMAE +v |
|---|---|---|---|---|---|---|
| P3 | | 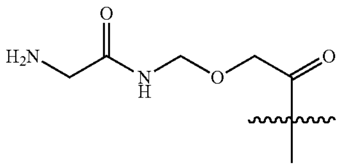 [SMILES: *C(=O)COCNC(=O)CN] | 44.857 | 3.011x | 22.161 | 23.426x |

Here "−v" stands for without verapamil and "+v" stands for with verapamil. Verapamil is a known inhibitor of P-glycoprotein and may function to block P-glycoprotein-modulated efflux.

Example 2: Linker2-Payloads

Example 2A: Linear Linker2-Payloads (LL2P)

Table 7, below, provides structures for exemplary linear linker2-payloads (LL2P) according to the disclosure.

TABLE 7
Structures of Linear Linker2-Payloads (LL2P)
| # | (P) | Structures |
|---|---|---|
| LP1 | P3 | 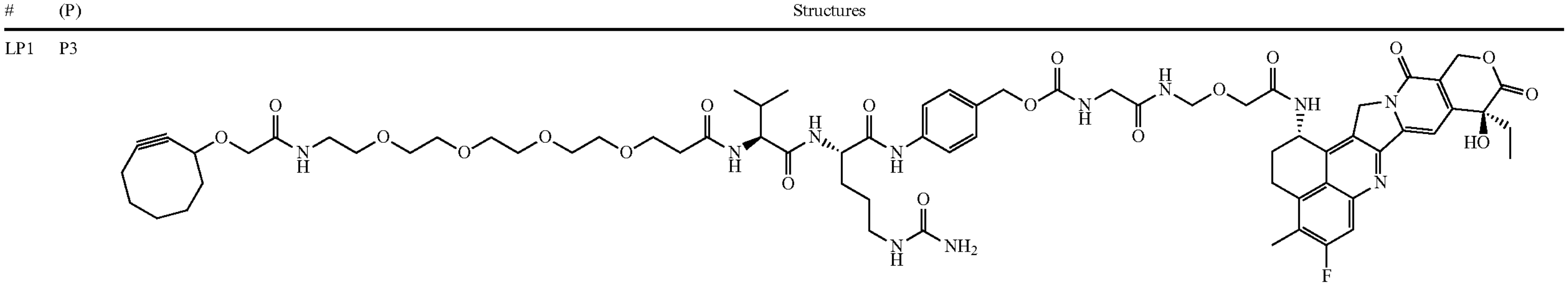 |
| LP2 | P3 | 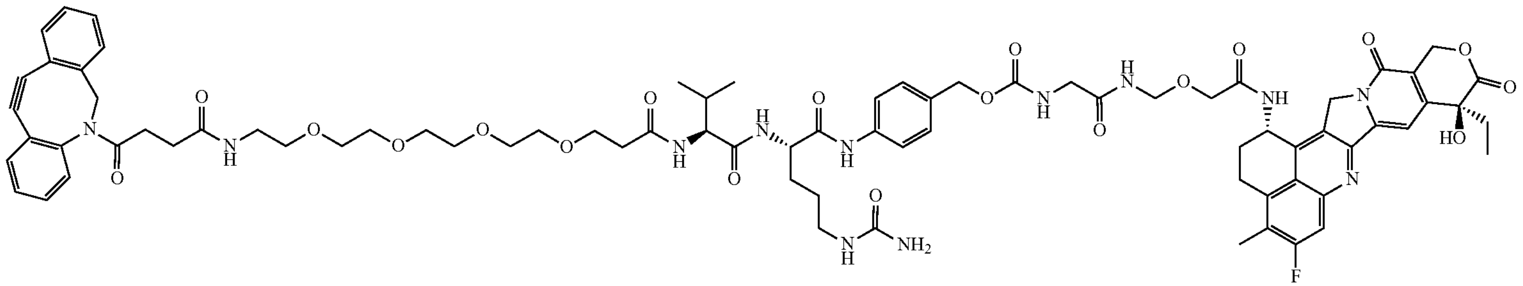 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)OCc1ccc(NC(=O)[C@H](CCCNC(N)=O)NC(=O)[C@@H](NC(=O)CCOCCOCCOCCOCCNC(=O)CCC(=O)N2Cc4ccccc4C#Cc4ccccc42)C(C)C)cc1)CC3] |
| LP3 | P3 | 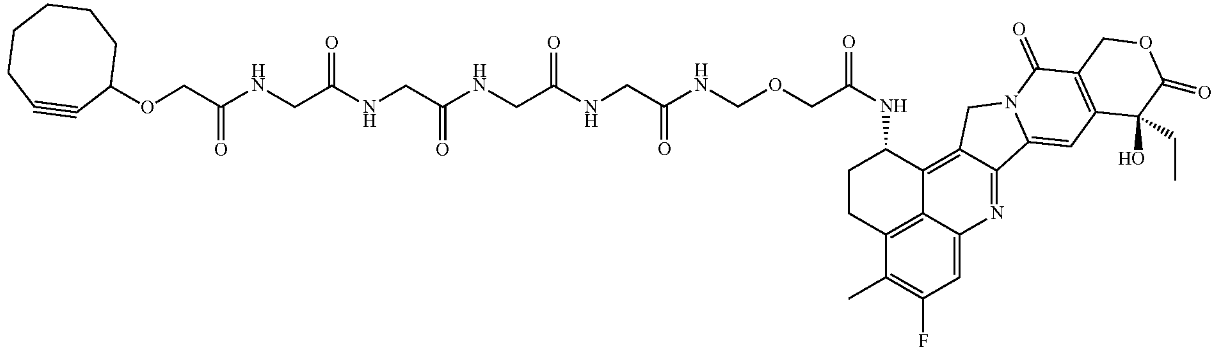 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)CNC(=O)CNC(=O)CNC(=O)COC1C#CCCCCC1)CC3] |

TABLE 7-continued
| Structures of Linear Linker2-Payloads (LL2P) | | |
|---|---|---|
| # | (P) | Structures |
| LP4 | P3 | 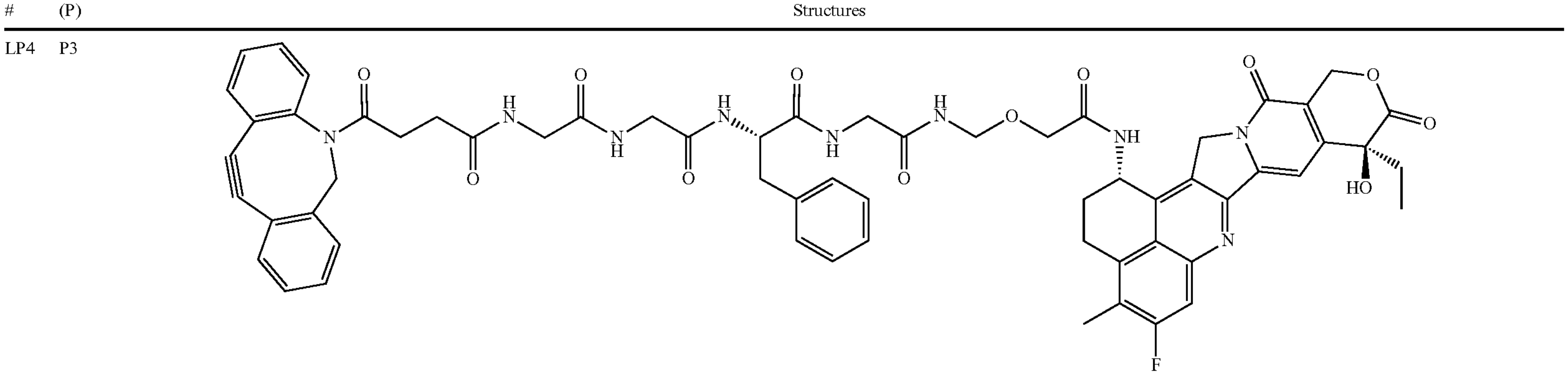 |
| LP5 | P3 | 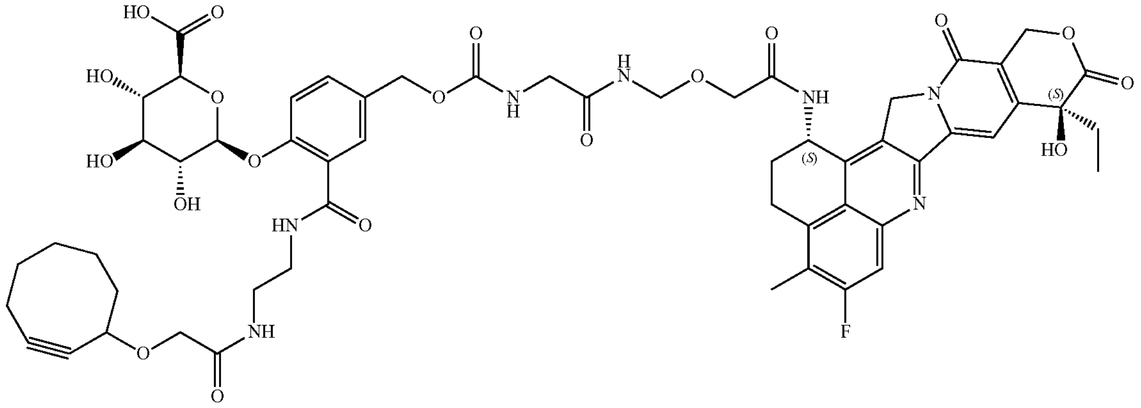 |

TABLE 7-continued
| Structures of Linear Linker2-Payloads (LL2P) | | |
|---|---|---|
| # | (P) | Structures |
| LP6 | P3 | 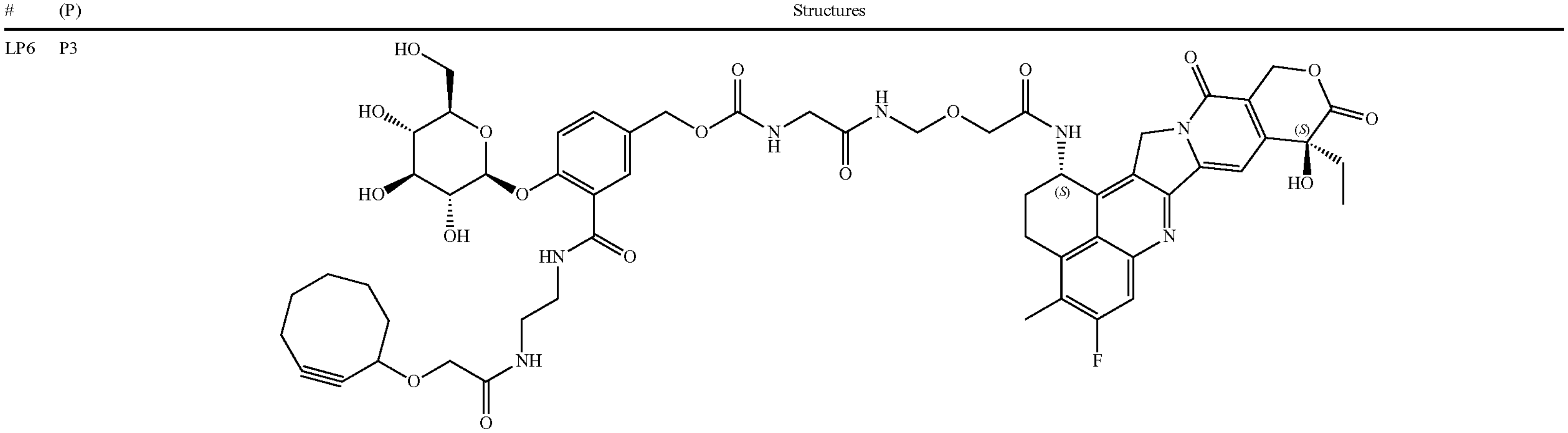 |
| LP7<br>LP7' | P4 | 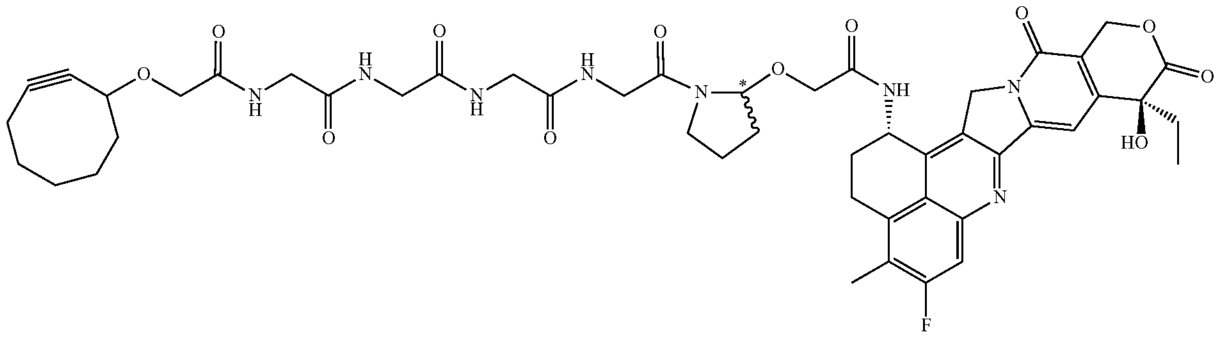 [SMILES: CC[C@@]1(O)C(=O)OCc2c1cc1n(c2=O)Cc2c-1nc1cc(F)c(C)c3c1c2[C@@H](NC(=O)COC1CCCN1C(=O)CNC(=O)CNC(=O)CNC(=O)CNC(=O)COC1C#CCCCCC1)CC3] |

TABLE 7-continued
| Structures of Linear Linker2-Payloads (LL2P) | | |
|---|---|---|
| # | (P) | Structures |
| LP8 | P4 | 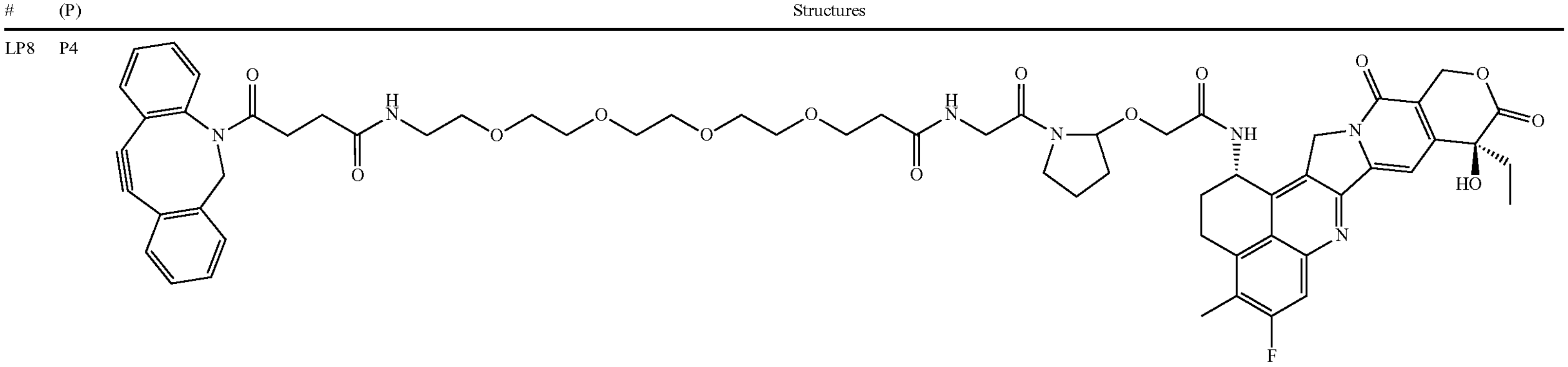 |
| LP9 | P3 | 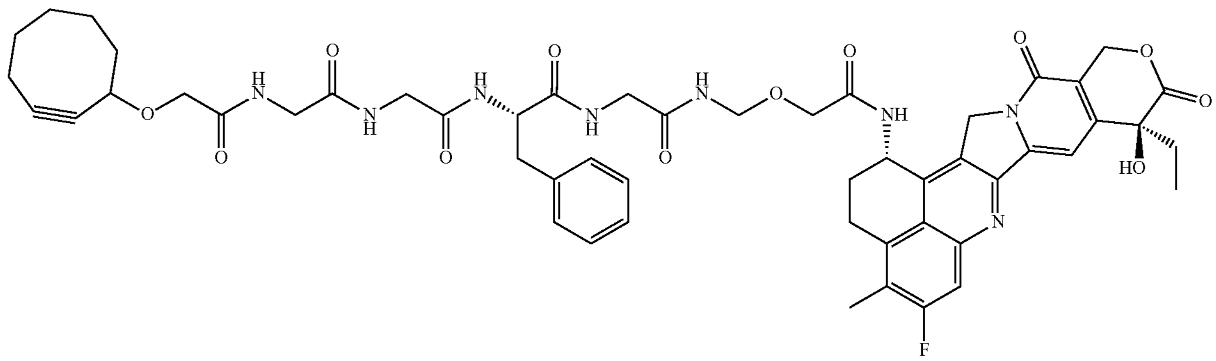 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)[C@H](Cc1ccccc1)NC(=O)CNC(=O)CNC(=O)COC1C#CCCCCC1)CC3] |

TABLE 7-continued
| Structures of Linear Linker2-Payloads (LL2P) | | |
|---|---|---|
| # | (P) | Structures |
| LP10 | P3 | 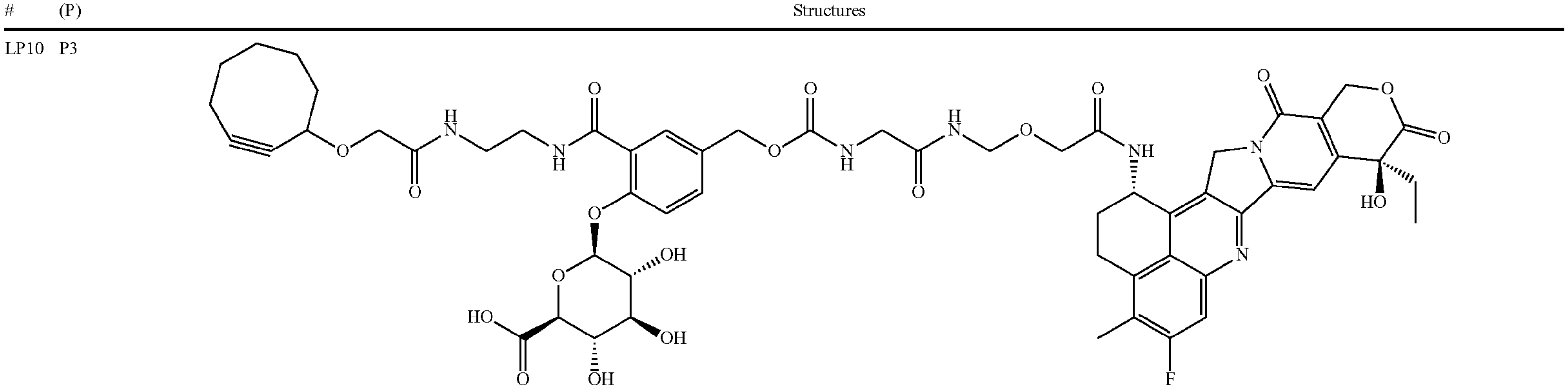 |
| LP11 | P3 | 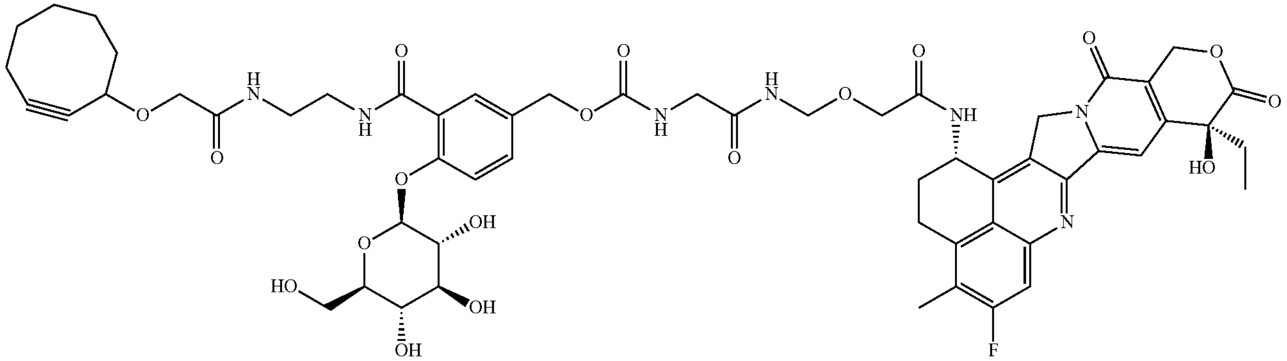 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)OCc1ccc(O[C@@H]2O[C@H](CO)[C@@H](O)[C@H](O)[C@H]2O)c(C(=O)NCCNC(=O)COC2C#CCCCCC2)c1)CC3] |

TABLE 7-continued
| Structures of Linear Linker2-Payloads (LL2P) | | |
|---|---|---|
| # | (P) | Structures |
| LP12 | P3 | 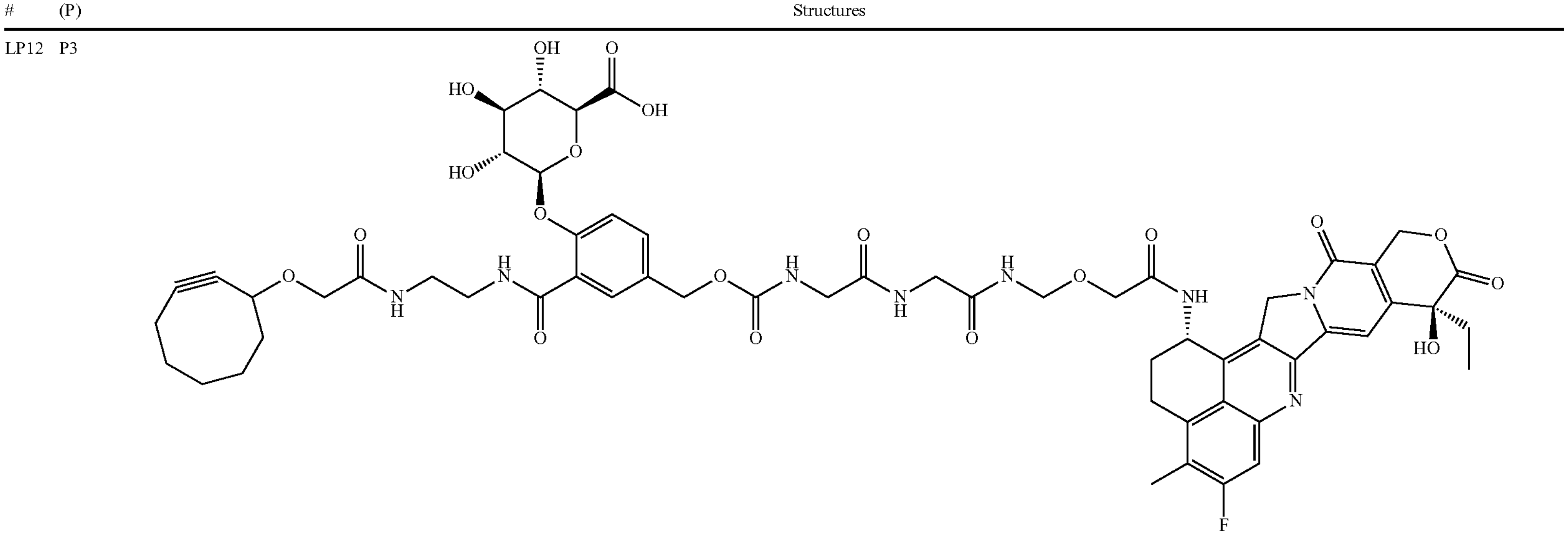 |
| LP13 | P3 | 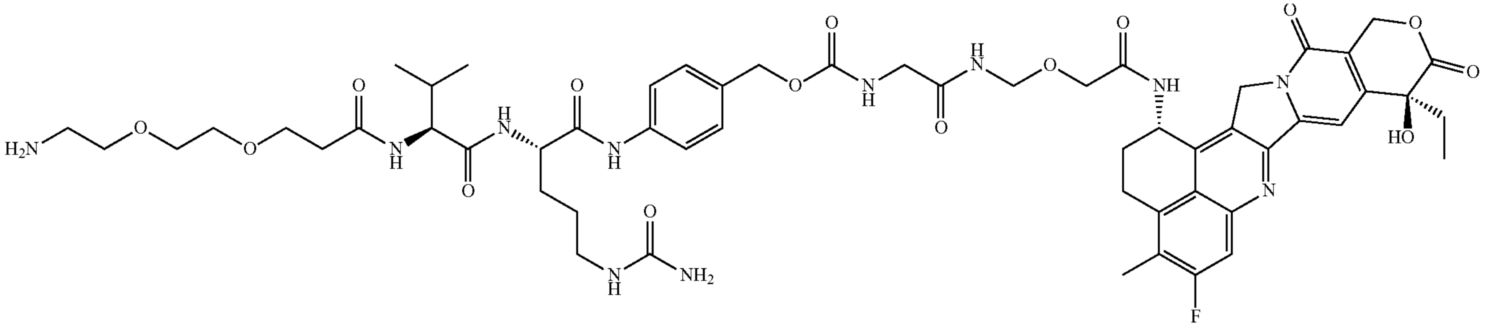 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)OCc1ccc(NC(=O)[C@H](CCCNC(N)=O)NC(=O)[C@@H](NC(=O)CCOCCOCCN)C(C)C)cc1)CC3] |

TABLE 7-continued
| Structures of Linear Linker2-Payloads (LL2P) | | |
|---|---|---|
| # | (P) | Structures |
| LP14 | P3 | 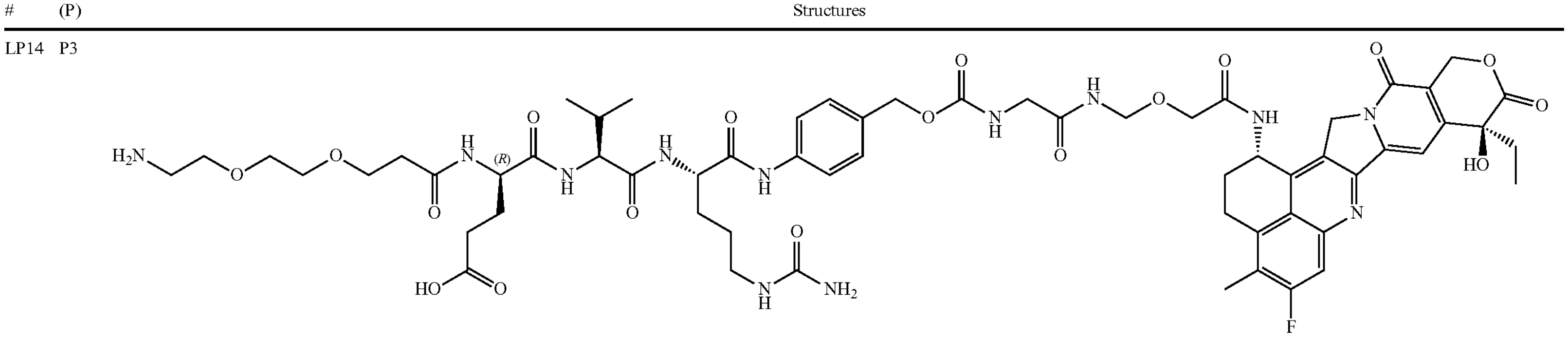 |
| LP15 | P3 | 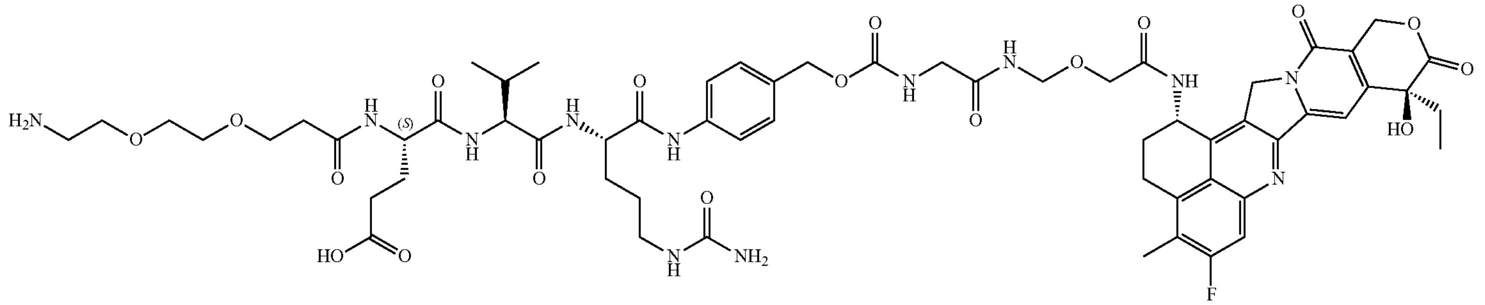 |
| LP16 | P3 | 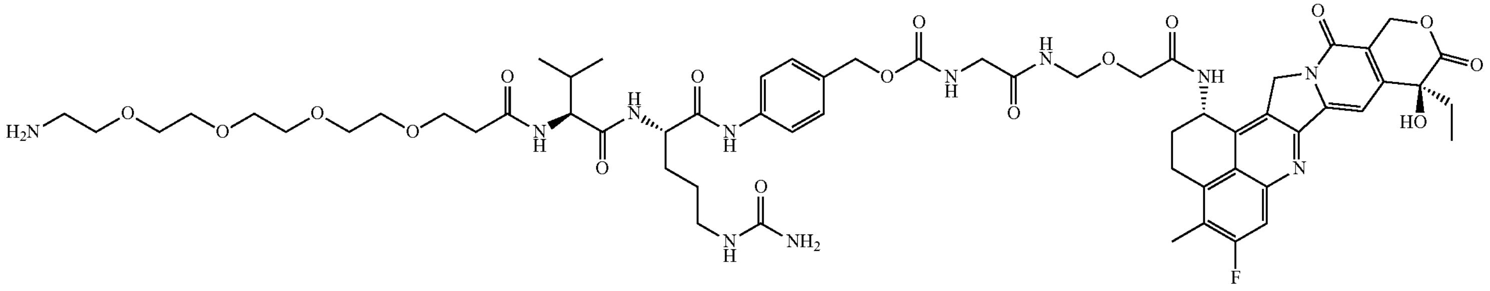 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)OCc1ccc(NC(=O)[C@H](CCCNC(N)=O)NC(=O)[C@@H](NC(=O)CCOCCOCCOCCOCCN)C(C)C)cc1)CC3] |

TABLE 7-continued
| Structures of Linear Linker2-Payloads (LL2P) | | |
|---|---|---|
| # | (P) | Structures |
| LP17 | P3 | 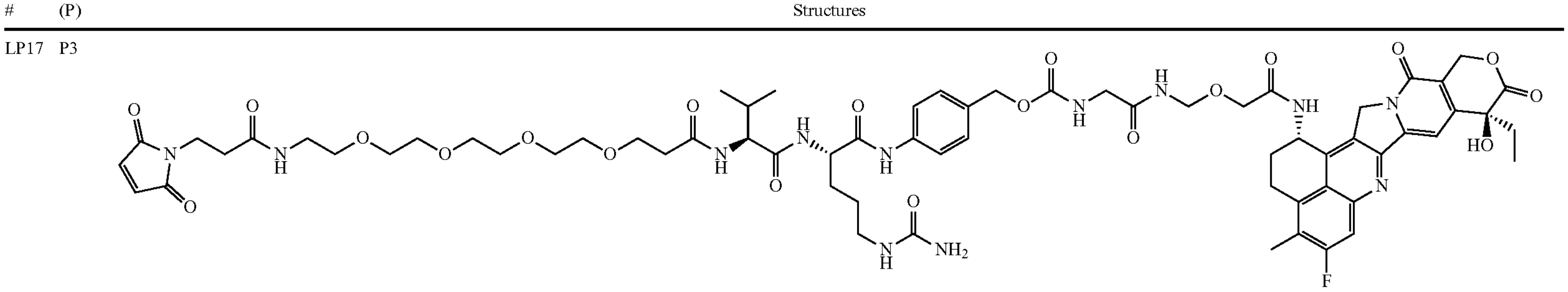 |
| LP18 | P3 | 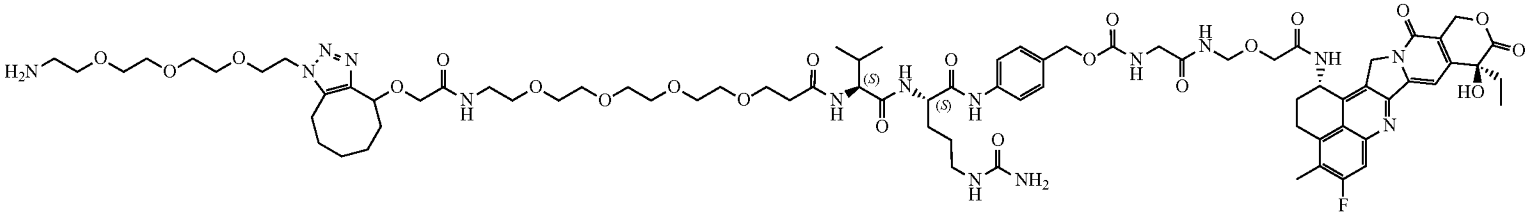 |
| LP19 | P3 | 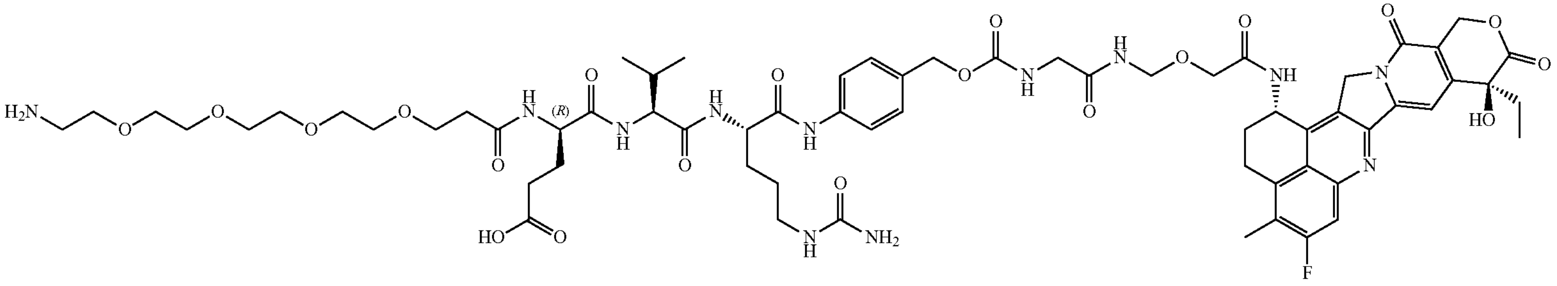 |

TABLE 7-continued
| Structures of Linear Linker2-Payloads (LL2P) | | |
|---|---|---|
| # | (P) | Structures |
| LP20 | P3 | 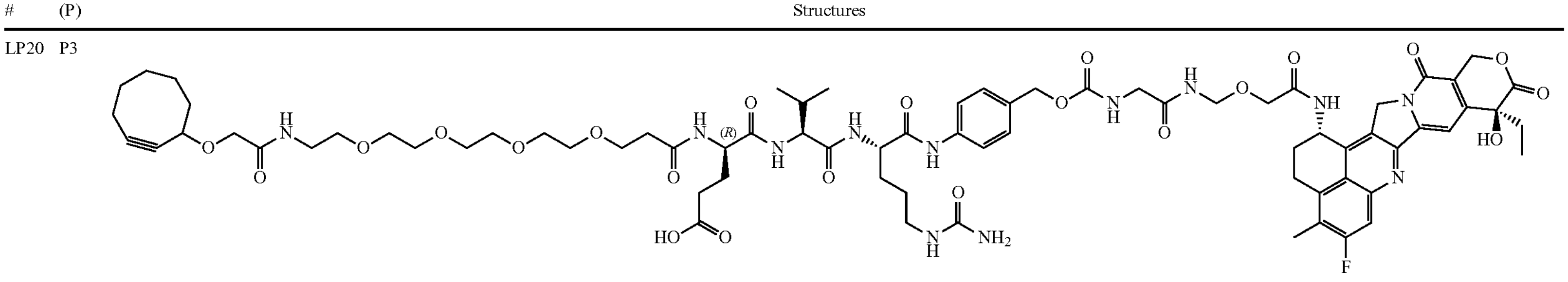 |
| LP21 | P3 | 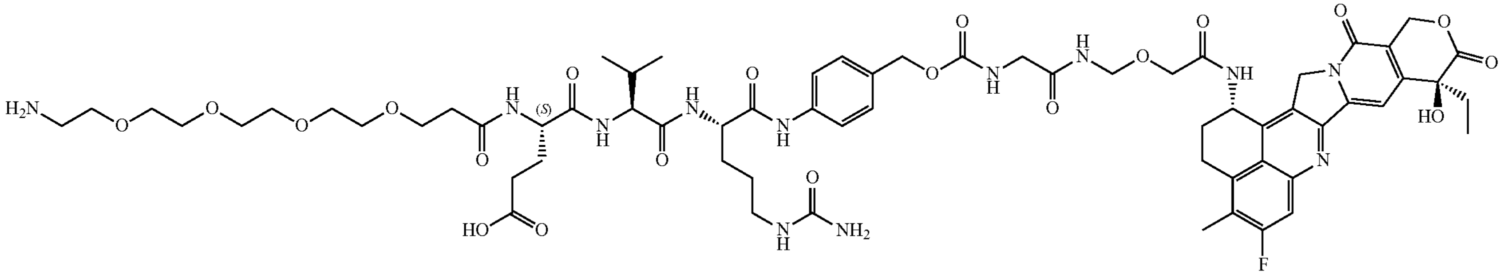 |
| LP22 | P3 | 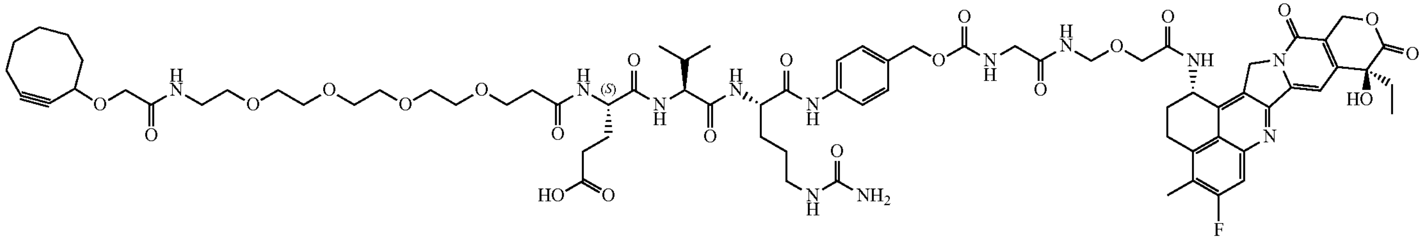 |

Table 8, below, provides the chemical properties of exemplary linear linker2-payloads (LL2p) according to the disclosure.

TABLE 8

| Chemical properties of Linker2-Payloads (LL2P) | | | | | | | |
|---|---|---|---|---|---|---|---|
| # | Linker name | Payloads | cLogP | MF | MW | Purity (%) | m/z |
| LP1 | COT-PEG4-vcPAB | P3 (Gly-$NHCH_2O$-Dxd) | 0.72 | $C_{69}H_{90}FN_{11}O_{19}$•$C_2HF_3O_2$ | 1510.54 | 96 | 698.8 (M/2 + H) |
| LP2 | DIBAC-PEG4-vcPAB | P3 (Gly-$NHCH_2O$-Dxd) | 1.46 | $C_{78}H_{91}FN_{12}O_{19}$ | 1519.65 | 95* | 760.5 (M/2 + H) |
| LP3 | COT-GGG | P3 (Gly-$NHCH_2O$-Dxd) | −1.84 | $C_{45}H_{51}FN_8O_{12}$ | 914.95 | 99 | 915.3 (M + H) |
| LP4 | DIBAC-GGF | P3 (Gly-$NHCH_2O$-Dxd) | 1.12 | $C_{61}H_{58}FN_9O_{12}$ | 1128.16 | 99 | 1128.4 (M + H) |
| LP5 | COT-EDA-(GLCA)PAB | P3 (Gly-$NHCH_2O$-Dxd) | −0.73 | $C_{56}H_{62}FN_7O_{19}$ | 1156.14 | 97 | 1156.3 (M + H) |
| LP6 | COT-EDA-(GLC)PAB | P3 (Gly-$NHCH_2O$-Dxd) | −0.66 | $C_{56}H_{64}FN_7O_{18}$ | 1142.16 | >95 | 1143.3 (M + H) |
| LP7 LP7' | COT-GGG | P4 (Gly-ProO-Dxd) | −1.23 | $C_{48}H_{55}FN_8O_{12}$ | 955.01 | >95* | 955.3 (M + H) |
| LP8 | DIBAC-PEG4 | P4 (Gly-ProO-Dxd) | 1.77 | $C_{62}H_{68}FN_7O_{14}$ | 1154.24 | 99* | 592.1 (fragment) |
| LP9 | COT-GGF | P3 (Gly-$NHCH_2O$-Dxd) | 0.38 | $C_{52}H_{57}FN_8O_{12}$ | 1005.1 | | 1005.0 (M + H) |
| LP10 | COT-PAB(GLCA) | P3 (Gly-$NHCH_2O$-Dxd) | −0.73 | $C_{56}H_{62}FN_7O_{19}$ | 1156.1 | | 1156.3 (M + H) |
| LP11 | COT-PAB(GLC) | P3 (Gly-$NHCH_2O$-Dxd) | −0.66 | $C_{56}H_{64}FN_7O_{18}$ | 1142.2 | | 1142.3 (M + H) |
| LP12 | COT-PAB (GLCA)-G | P3 (Gly-$NHCH_2O$-Dxd) | −1.84 | $C_{58}H_{65}FN_8O_{20}$ | 1213.2 | | 607.4 (M/2 + H) |
| LP13 | NH2-PEG2-vcPAB | P3 (Gly-$NHCH_2O$-Dxd) | −1.26 | $C_{55}H_{70}FN_{11}O_{15}$ | 1144.2 | | 573.0 (M/2 + H) |
| LP14 | NH2-PEG2-$^D$EvcPAB | P3 (Gly-$NHCH_2O$-Dxd) | −4.41 | $C_{60}H_{77}FN_{12}O_{18}$ | 1273.3 | | 637.5 (M/2 + H) |
| LP15 | NH2-PEG2-$^L$EvcPAB | P3 (Gly-$NHCH_2O$-Dxd) | −4.41 | $C_{60}H_{77}FN_{12}O_{18}$ | 1273.3 | | 637.4 (M/2 + H) |
| LP16 | NH2-PEG4-vcPAB | P3 (Gly-$NHCH_2O$-Dxd) | −1.35 | $C_{59}H_{78}FN_{11}O_{17}$ | 1232.3 | | 616.9 (M/2 + H) |
| LP17 | Mc(3)-PEG4-vcPAB-G-NHCH2-Dxd | P3 (Gly-$NHCH_2O$-Dxd) | −2.01 | $C_{66}H_{83}FN_{12}O_{20}$ | 1383.5 | | 692.4 (M/2 + H) |

TABLE 8-continued

| Chemical properties of Linker2-Payloads (LL2P) | | | | | | | |
|---|---|---|---|---|---|---|---|
| # | Linker name | Payloads | cLogP | MF | MW | Purity (%) | m/z |
| LP18 | | P3 (Gly-$NHCH_2O$-Dxd) | | | | | |
| LP19 | NH2-PEG4-$^{D}$EvcPAB | P3 (Gly-$NHCH_2O$-Dxd) | −4.51 | $C_{64}H_{85}FN_{12}O_{20}$ | 1361.4 | | 681.5 (M/2 + H) |
| LP20 | COT-PEG4-$^{D}$EvcPAB | P3 (Gly-$NHCH_2O$-Dxd) | −0.28 | $C_{74}H_{97}FN_{12}O_{22}$ | 1525.7 | | 763.5 (M/2 + H) |
| LP21 | NH2-PEG4-$^{L}$EvcPAB | P3 (Gly-$NHCH_2O$-Dxd) | −4.51 | $C_{64}H_{85}FN_{12}O_{20}$ | 1361.4 | | 681.4 (M/2 + H) |
| LP22 | COT-PEG4-$^{L}$EvcPAB | P3 (Gly-$NHCH_2O$-Dxd) | −0.28 | $C_{74}H_{97}FN_{12}O_{22}$ | 1525.7 | | 763.5 (M/2 + H) |

*Mixture of lactone and ring-opening products. Values of MW and m/z are data of the corresponding lactone.

Example 2B: Branched Linker2-Payloads (BL2P)

Table 9, below, provides structures for exemplary branching units B1-B5 according to the disclosure.

TABLE 9

| Structures of Branching Units B1-B5 | | |
|---|---|---|
| Branch B | B1 | B2 |
| Structure | 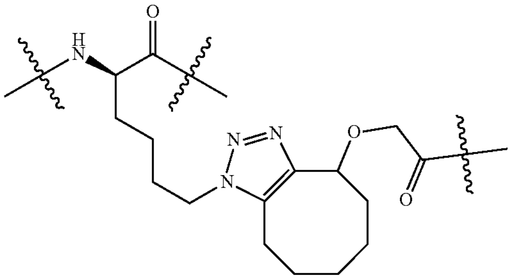 [SMILES: *N[C@H](CCCCn1nnc2c1CCCCCC2OCC(*)=O)C(*)=O] | 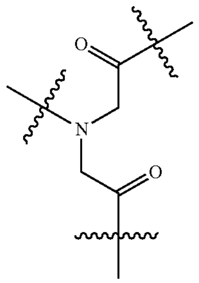 [SMILES: *C(=O)CN(*)CC(*)=O] |
| Branch B | B3 | B4 |
| Structure | 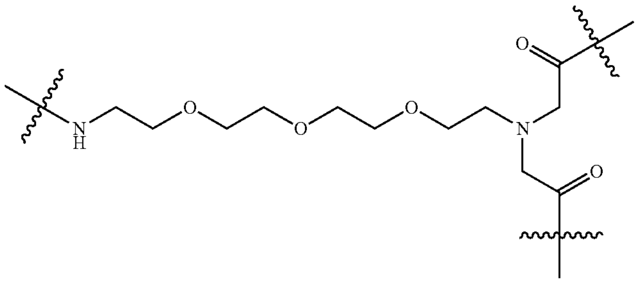 [SMILES: *NCCOCCOCCOCCN(CC(*)=O)CC(*)=O] | 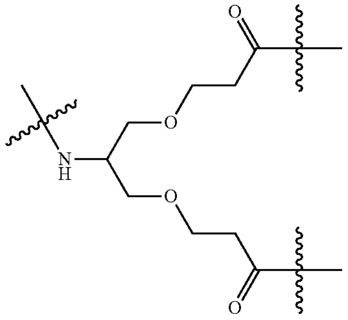 [SMILES: *NC(COCCC(*)=O)COCCC(*)=O] |

TABLE 9-continued
| Structures of Branching Units B1-B5 | |
|---|---|
| Branch B | B5 |
| Structure | 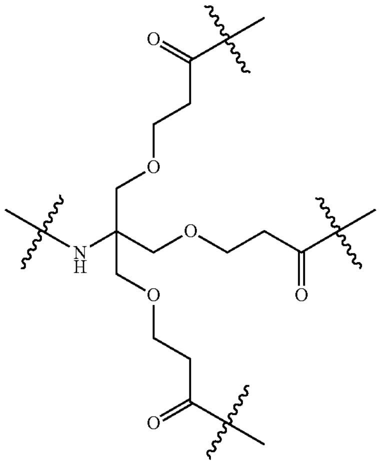 [SMILES: *NC(COCCC(*)=O)(COCCC(*)=O)COCCC(*)=O] |
Table 10, below, provides structures for exemplary branched linker2-payloads (BL2P) according to the disclosure.

TABLE 10
| Structures of Branched Linker2-Payloads (BL2P) | | | |
|---|---|---|---|
| # | LP name | cLogP | Structures |
| LP23 | COT-PEG4-CO-B1-(LP')(LP")<br>LP' = GGFG-NHCH2-Dxd<br>LP" = NH2-PEG4-GGFG-$NHCH_2$-Dxd | −2.17 | 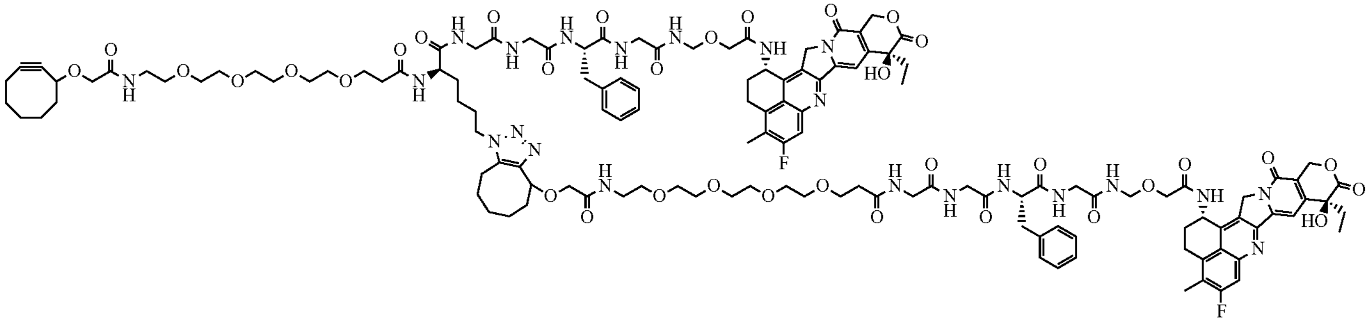 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)[C@H](Cc1ccccc1)NC(=O)CNC(=O)CNC(=O)CCOCCOCCOCCOCCNC(=O)COC1CCCCCc2c1nnn2CCCC[C@@H](NC(=O)CCOCCOCCOCCOCCNC(=O)COC1C#CCCCCC1)C(=O)NCC(=O)NCC(=O)N[C@@H](Cc1ccccc1)C(=O)NCC(=O)NCOCC(=O)N[C@H]1CCc2c(C)c(F)cc4nc5c(c1c24)Cn1c-5cc2c(c1=O)COC(=O)[C@]2(O)CC)CC3] |
| LP24 | COT-B2-[NH-PEG2-vcPAB-G-NHCH2-Dxd]2 | −1.80 | 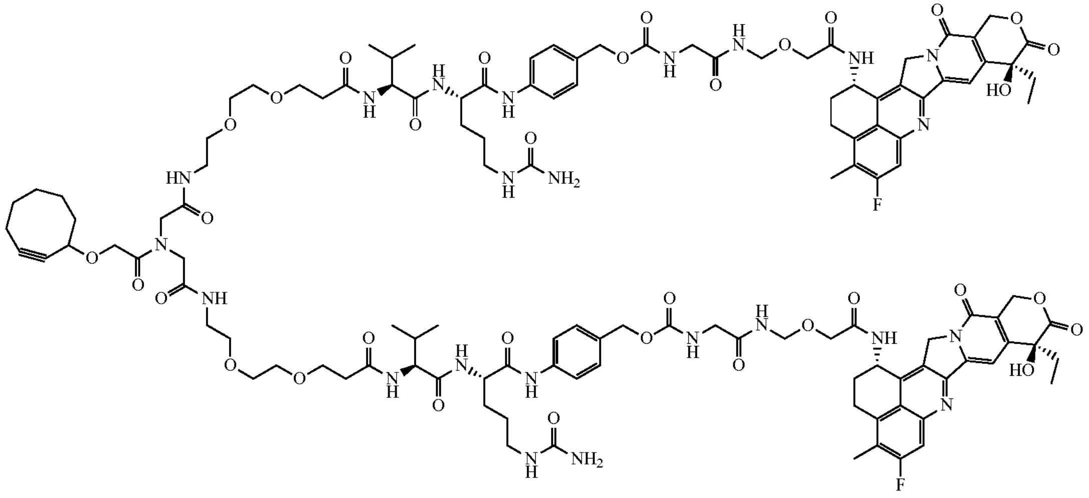 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)OCc1ccc(NC(=O)[C@H](CCCNC(N)=O)NC(=O)[C@@H](NC(=O)CCOCCOCCNC(=O)CN(CC(=O)NCCOCCOCCC(=O)N[C@H](C(=O)N[C@@H](CCCNC(N)=O)C(=O)Nc2ccc(COC(=O)NCC(=O)NCOCC(=O)N[C@H]4CCc5c(C)c(F)cc6nc7c(c4c56)Cn4c-7cc5c(c4=O)COC(=O)[C@]5(O)CC)cc2)C(C)C)C(=O)COC2C#CCCCCC2)C(C)C)cc1)CC3] |

TABLE 10-continued
| Structures of Branched Linker2-Payloads (BL2P) | | | |
|---|---|---|---|
| # | LP name | cLogP | Structures |
| LP25 | COT-B2-[NH-PEG2-$^{D}$EvcPAB-G-NHCH2-Dxd]2 | −3.80 | 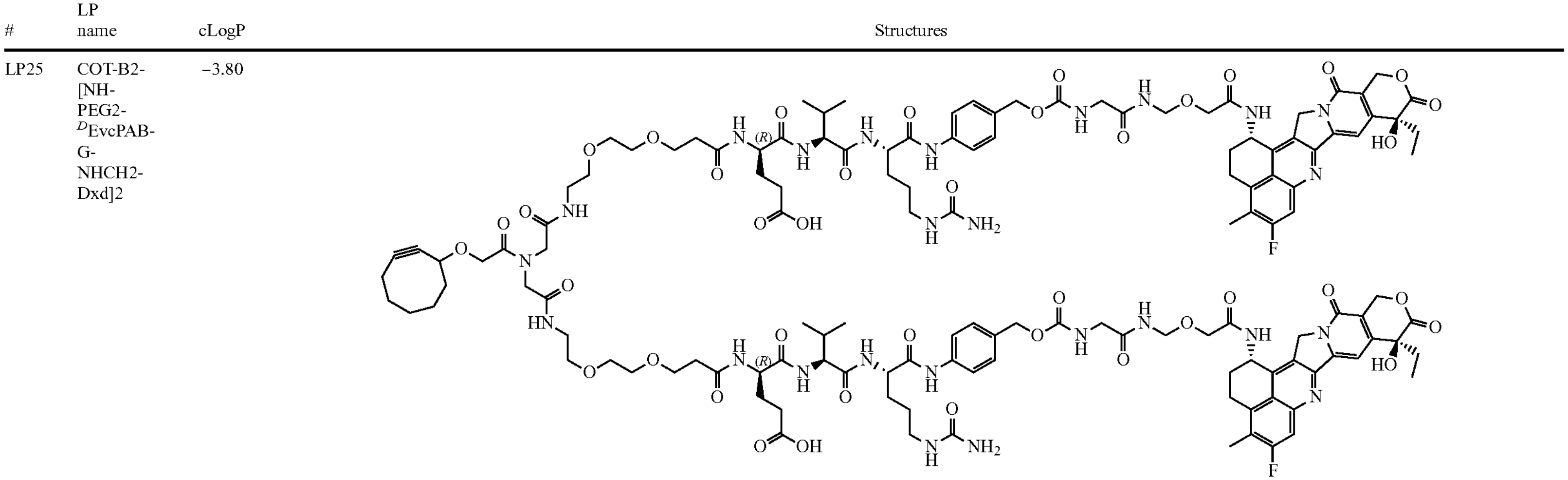 |
| LP26 | DIBAC-suc-B2-[NH-PEG4-vcPAB-G-NHCH2-Dxd]2 | −1.25 | 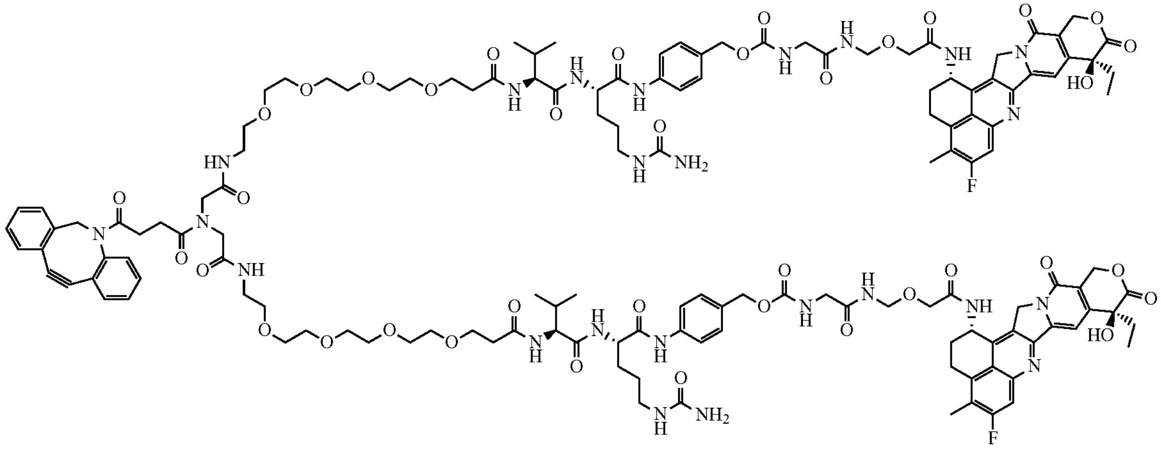 [SMILES: CC[C@@]1(O)C(=O)OCc2c1cc1n(c2=O)Cc2c-1nc1cc(F)c(C)c3c1c2[C@@H](NC(=O)COCNC(=O)CNC(=O)OCc1ccc(NC(=O)[C@H](CCCNC(N)=O)NC(=O)[C@@H](NC(=O)CCOCCOCCOCCOCCNC(=O)CN(CC(=O)NCCOCCOCCOCCOCCC(=O)N[C@H](C(=O)N[C@@H](CCCNC(N)=O)C(=O)Nc2ccc(COC(=O)NCC(=O)NCOCC(=O)N[C@H]4CCc5c(C)c(F)cc6nc7c(c4c56)Cn4c-7cc5c(c4=O)COC(=O)[C@]5(O)CC)cc2)C(C)C)C(=O)CCC(=O)N2Cc4ccccc4C#Cc4ccccc42)C(C)C)cc1)CC3] |

TABLE 10-continued
| Structures of Branched Linker2-Payloads (BL2P) | | | |
|---|---|---|---|
| # | LP name | cLogP | Structures |
| LP27 | B3-[NH-PEG2-vcPAB-G-NHCH2-Dxd]2 | −4.22 | 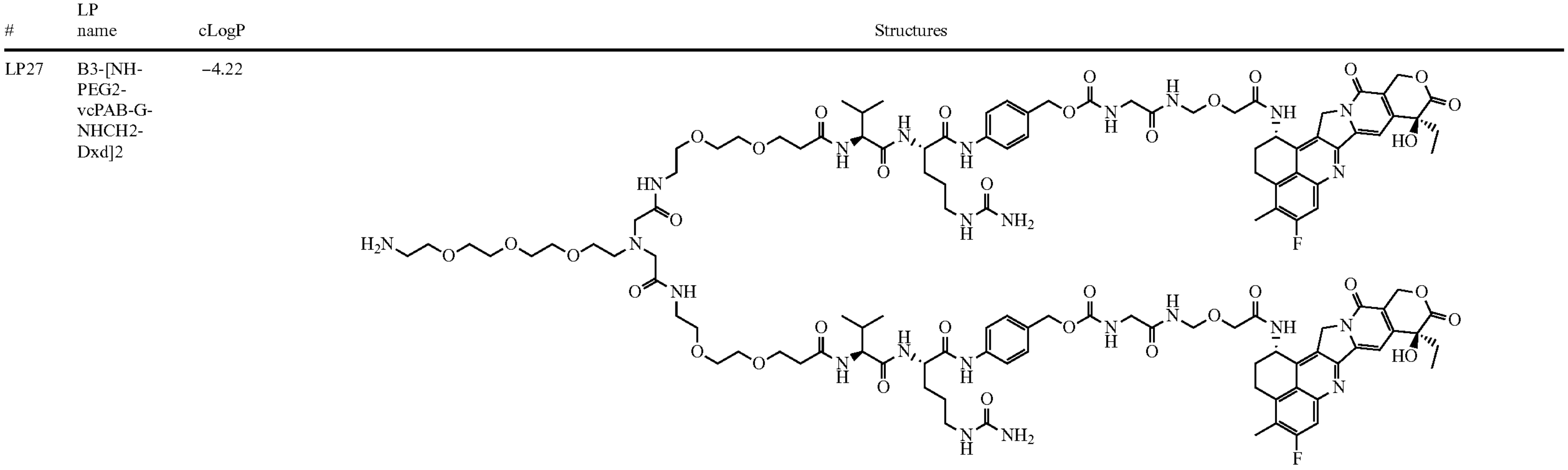 |
| LP28 | COT-B3-[NH-PEG2-$^{D}$EvcPAB-G-NHCH2-Dxd]2 | −4.15 | 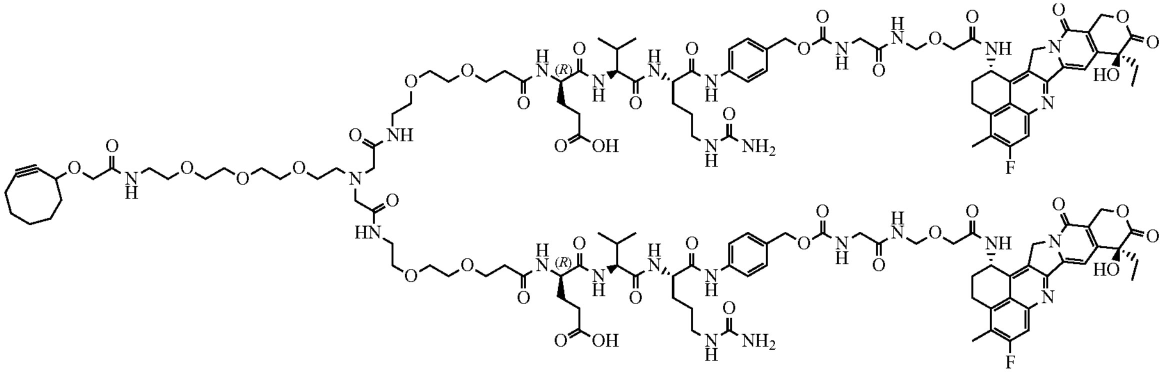 |

TABLE 10-continued
| Structures of Branched Linker2-Payloads (BL2P) | | | |
|---|---|---|---|
| # | LP name | cLogP | Structures |
| qLP29 | NH2-PEG3-TCOT-B3-[NH-PEG2-$^{D}$EvcPAB-G-NHCH2-Dxd]2 | −8.21 | 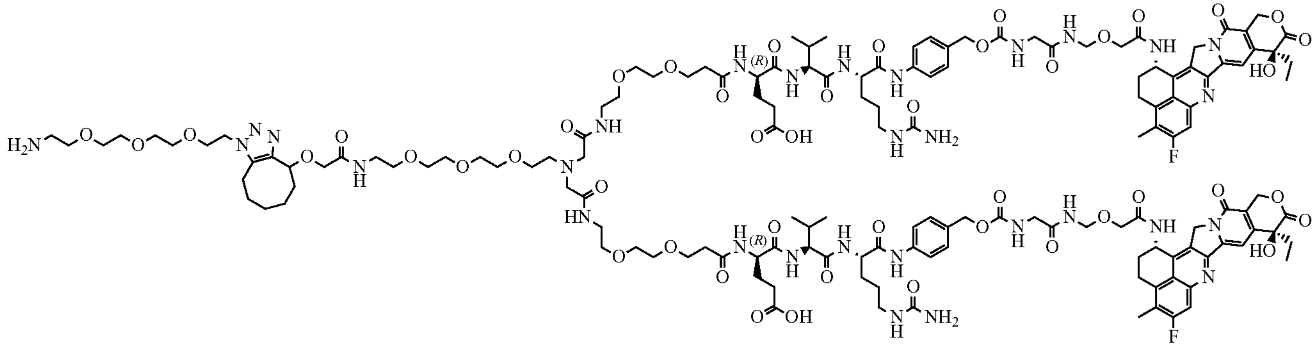 |
| LP30 | DIBAC-suc-B3-[NH-PEG2-$^{D}$EvcPAB-G-NHCH2-Dxd]2 | −3.41 | 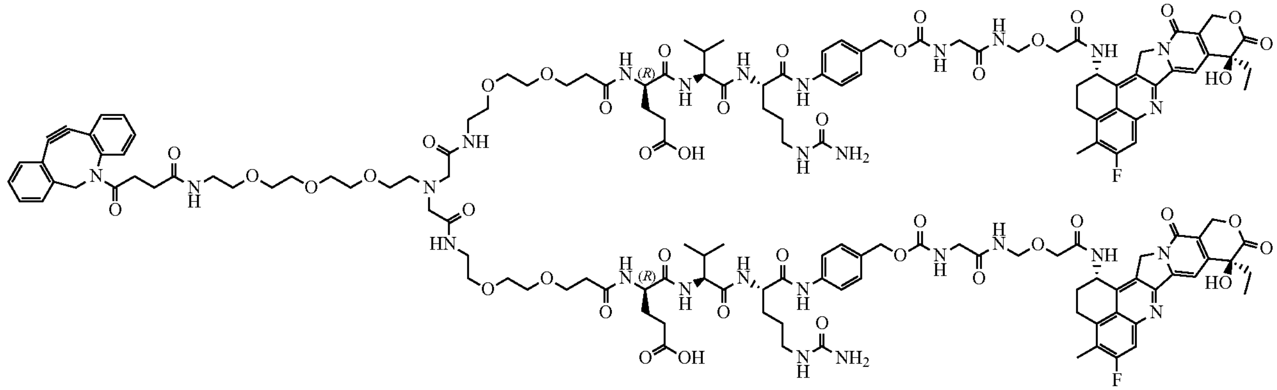 |

TABLE 10-continued
| Structures of Branched Linker2-Payloads (BL2P) | | | |
|---|---|---|---|
| # | LP name | cLogP | Structures |
| LP31 | B3-[NH-PEG2-$^{L}$EvcPAB-G-NHCH2-Dxd]2 | −8.57 | 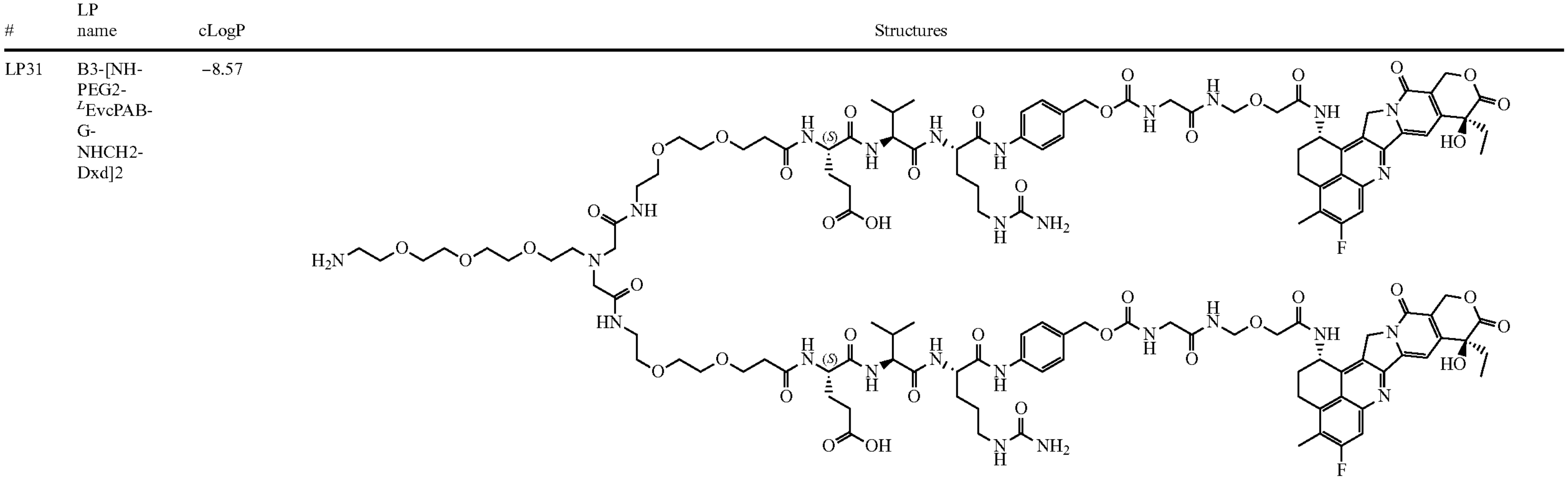 |
| LP32 | COT-B3-[NH-PEG2-$^{L}$EvcPAB-G-NHCH2-Dxd]2 | −4.15 | 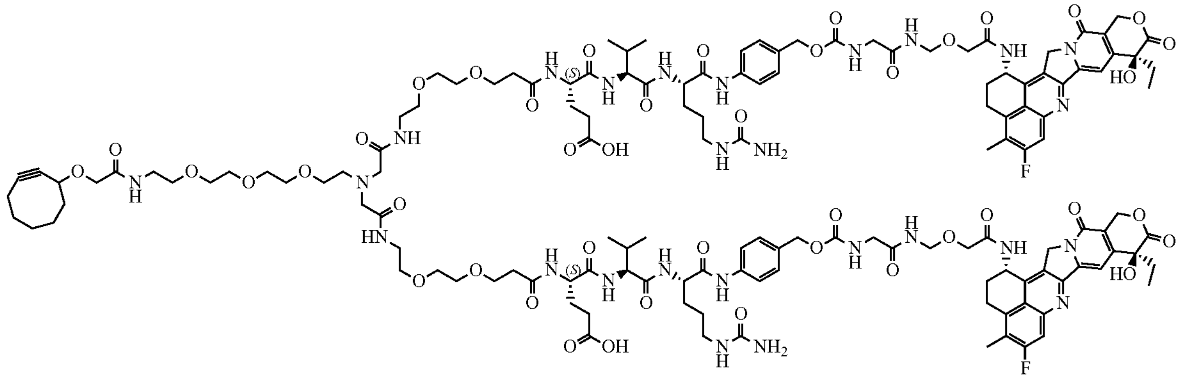 |

TABLE 10-continued
| Structures of Branched Linker2-Payloads (BL2P) | | | |
|---|---|---|---|
| # | LP name | cLogP | Structures |
| qLP33 | NH2-PEG3-TCOT-B3-[NH-PEG2-$^{L}$EvcPAB-G-NHCH2-Dxd]2 | −8.21 | 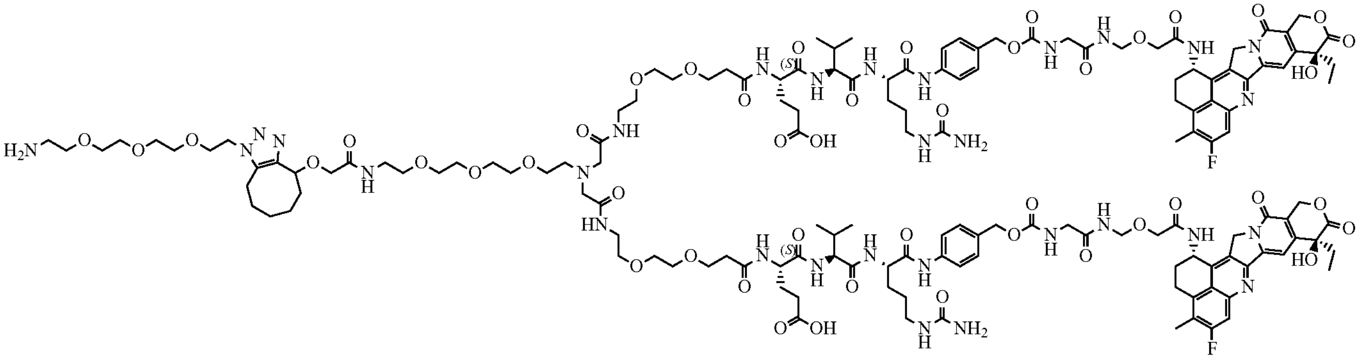 |
| LP34 | DIBAC-suc-B3-[NH-PEG2-$^{L}$EvcPAB-G-NHCH2-Dxd]2 | −3.41 | 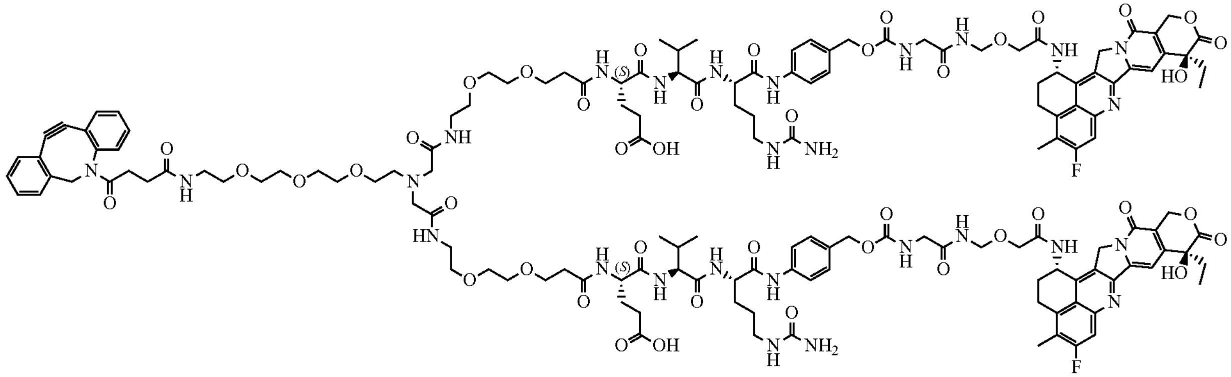 |

TABLE 10-continued
Structures of Branched Linker2-Payloads (BL2P)
| # | LP name | cLogP | Structures |
|---|---|---|---|
| LP35 | COT-B3-[NH-PEG2-GGFG-NHCH2-Dxd]2 | −4.94 | 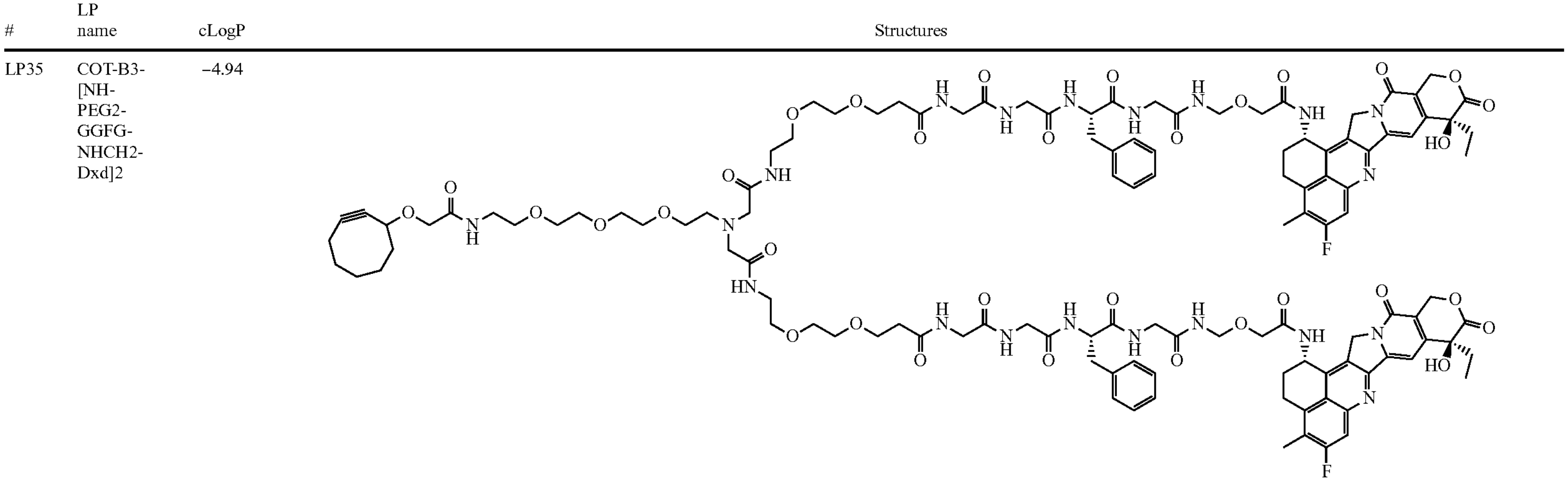 |
| LP36 | COT-B4-[NH-PEG2-$^{D}$EVCPAB-G-NHCH2-Dxd]2 | −3.59 | 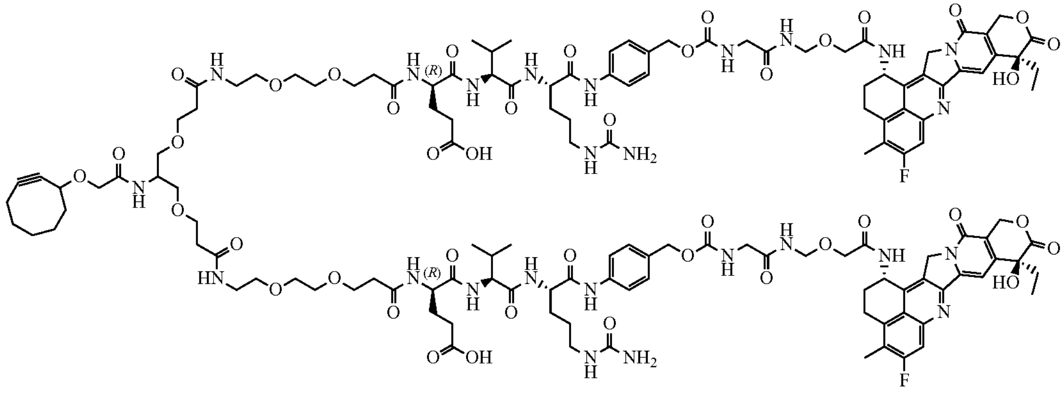 |

TABLE 10-continued
| Structures of Branched Linker2-Payloads (BL2P) | | | |
|---|---|---|---|
| # | LP name | cLogP | Structures |
| LP37 | COT-B4-[NH-PEG2-$^{L}$EVCPAB-G-NHCH2-Dxd]2 | −3.59 | 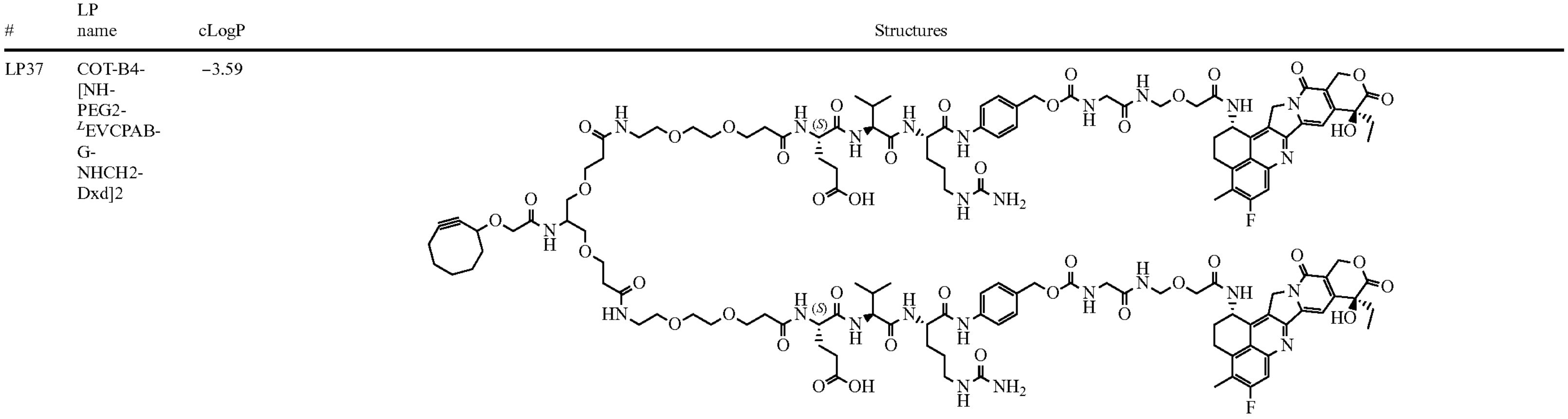 |
| LP38 | COT-PEG2-B4-[NH-PEG2-$^{L}$EVCPAB-G-NHCH2-Dxd]2 | −4.55 | 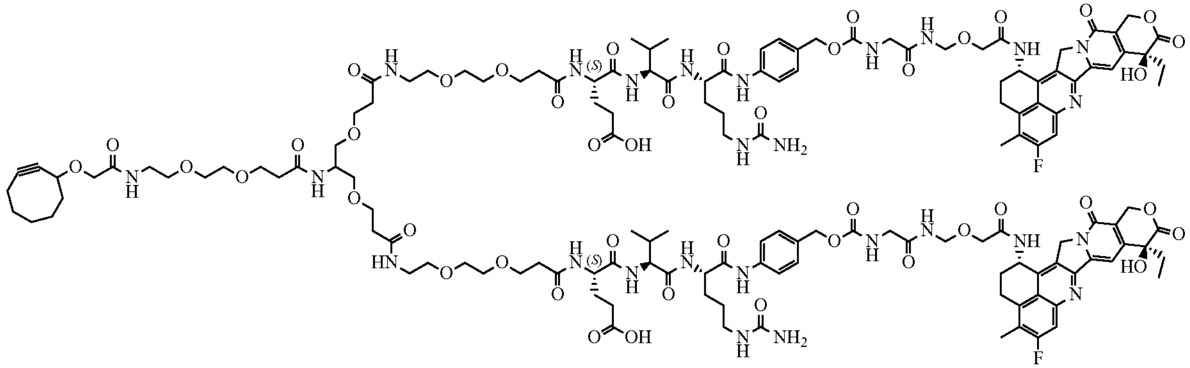 |

TABLE 10-continued
| Structures of Branched Linker2-Payloads (BL2P) | | | |
|---|---|---|---|
| # | LP name | cLogP | Structures |
| LP39 | COT-PEG2-B4-[NH-$^L$EVCPAB-G-NHCH2-Dxd]2 | −2.63 | 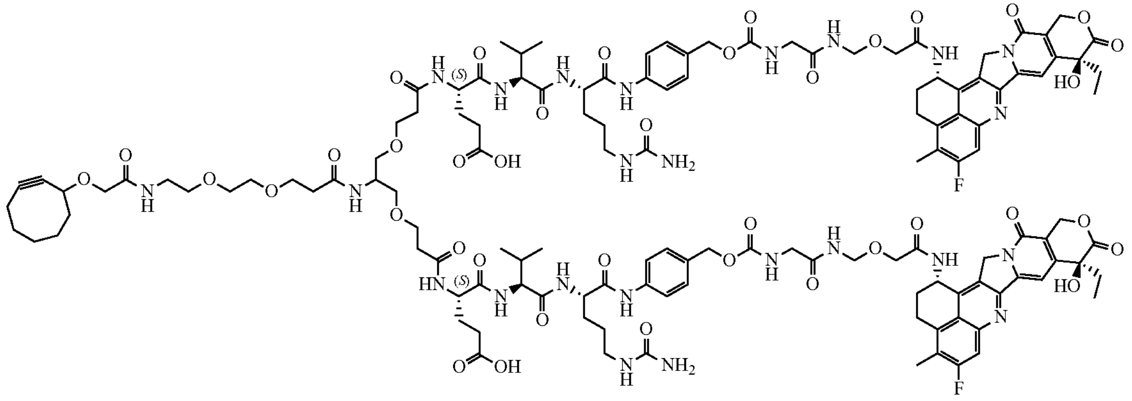 |
| qLP40 | NH2-PEG3-TCOT-PEG2-B4-[NH-$^L$EVCPAB-G-NHCH2-Dxd]2 | −6.69 | 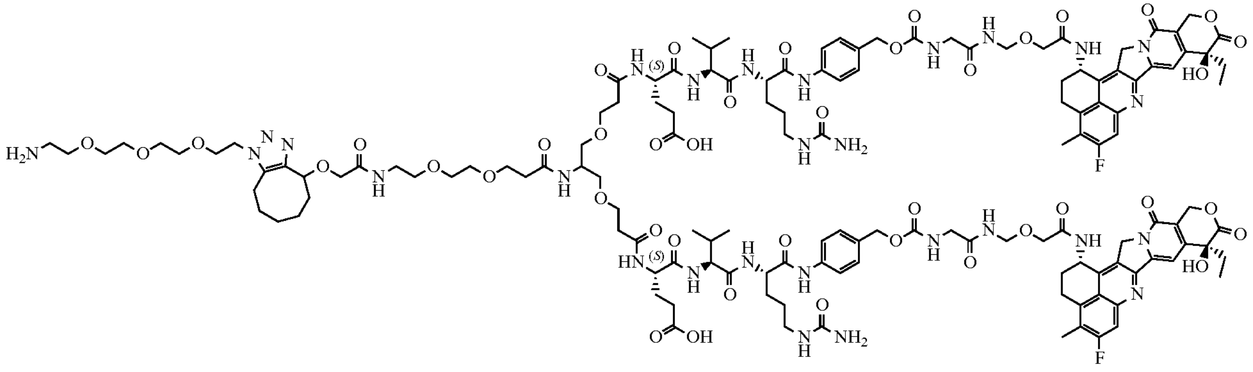 |

TABLE 10-continued
| Structures of Branched Linker2-Payloads (BL2P) | | | |
|---|---|---|---|
| # | LP name | cLogP | Structures |
| LP41 | COT-PEG2-B5-[NH-PEG2-$^{L}$EVCPAB-G-NHCH2-Dxd]3 | −6.84 | 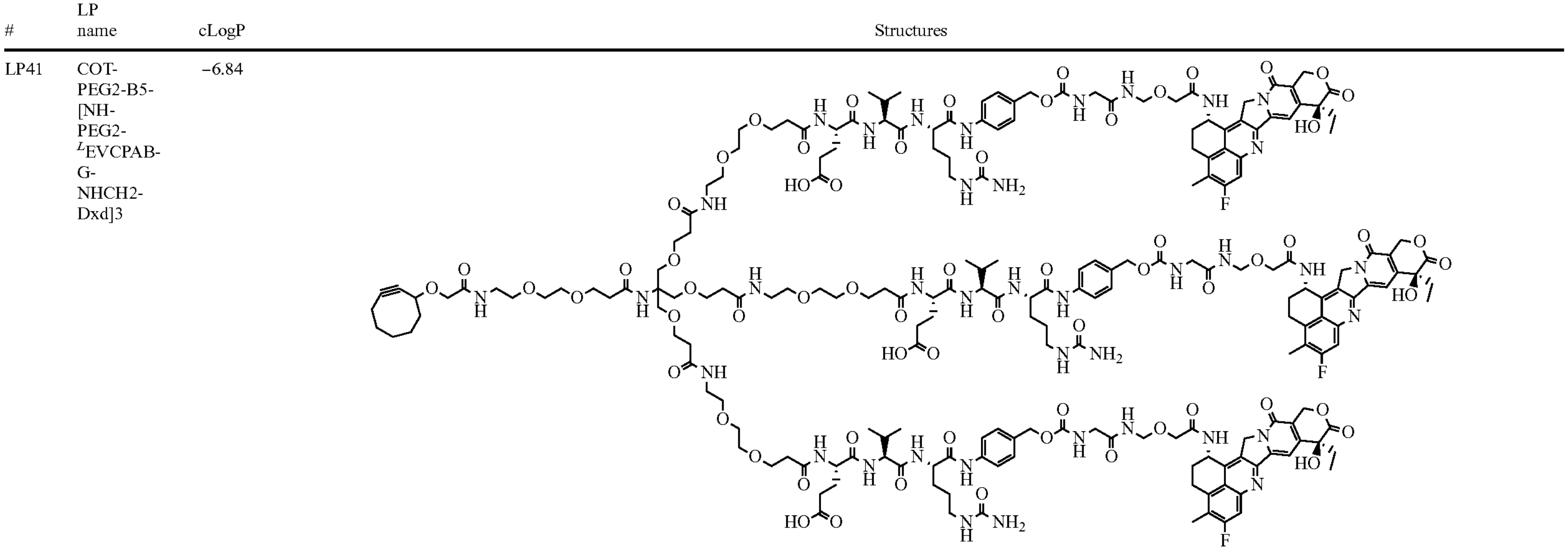 |

TABLE 10-continued
| Structures of Branched Linker2-Payloads (BL2P) | | | |
|---|---|---|---|
| # | LP name | cLogP | Structures |
| qLP42 | NH2-PEG3-TCOT-PEG2-B5-[NH-PEG2-$^{L}$EVCPAB-G-NHCH2-Dxd]3 | −11.22 | 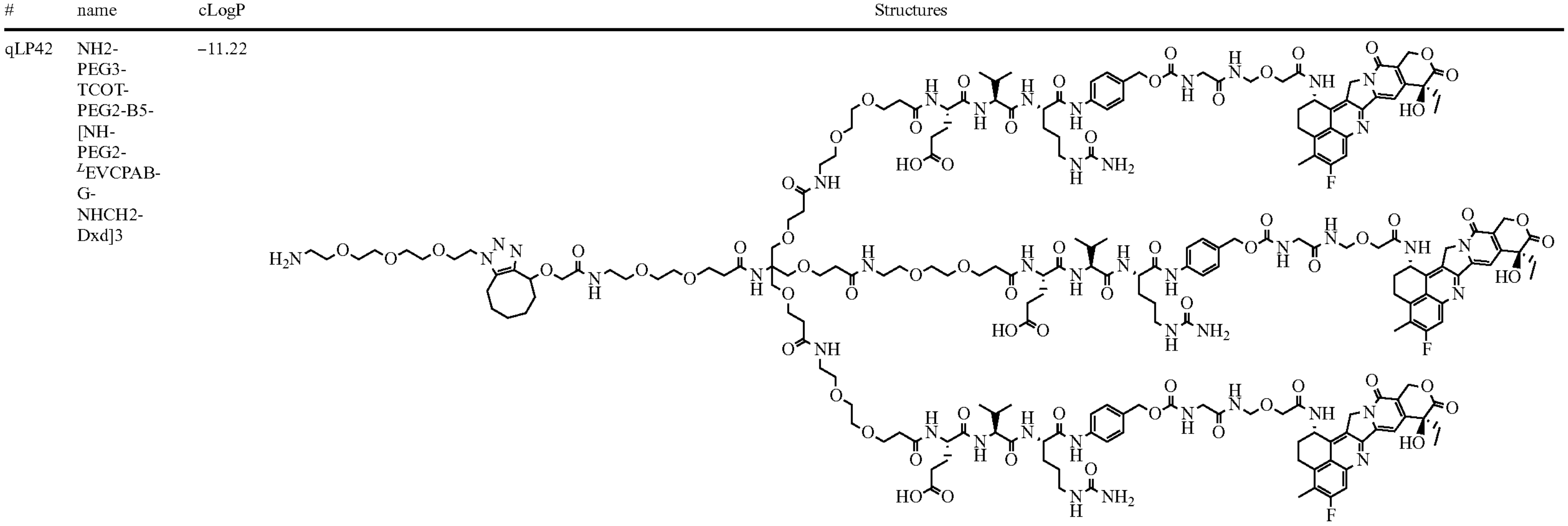 |

Table 11, below, provides the chemical properties of exemplary branched linker2-payloads (BL2P) according to the disclosure.

TABLE 11

| Chemical properties of Branched Linker2-Payloads (BL2P) | | | | | |
|---|---|---|---|---|---|
| # | LP name | cLogP | MF | MW | Mass |
| LP23 | COT-PEG4-CO-B1-(LP1)(LP2) LP1 = GGFG-NHCH2-Dxd LP2 = NH2-PEG4-GGFG-NHCH2-Dxd | −2.17 | $C_{132}H_{166}F_2N_{22}O_{35}$ | 2658.9 | 887.6 (M/3 + H) |
| LP24 | COT-B2-[NH-PEG2-vcPAB-G-NHCH2-Dxd]2 | −1.80 | $C_{124}H_{155}F_2N_{23}O_{34}$ | 2549.7 | 850.8 (M/3 + H) |
| LP25 | COT-B2-[NH-PEG2-$^{D}$EvcPAB-G-NHCH2-Dxd]2 | −3.80 | $C_{134}H_{169}F_2N_{25}O_{40}$ | 2808.0 | 936.7 (M/3 + H) |
| LP26 | DIBAC-suc-B2-[NH-PEG4-vcPAB-G-NHCH2-Dxd]2 | −1.25 | $C_{141}H_{172}F_2N_{24}O_{38}$ | 2849.1 | 717.3 (M/4 + H) (ring-open form) 950.2 (M/3 + H) (latone form) |
| LP27 | B3-[NH-PEG2-vcPAB-G-NHCH2-Dxd]2 | −4.22 | $C_{122}H_{160}F_2N_{24}O_{35}$ | 2560.8 | 1280.9 (M/2 + H) |
| LP28 | COT-B3-[NH-PEG2-$^{D}$EvcPAB-G-NHCH2-Dxd]2 | −4.15 | $C_{142}H_{186}F_2N_{26}O_{43}$ | 2983.2 | 995.2 (M/3 + H) |
| qLP29 | NH2-PEG3-TCOT-B3-[NH-PEG2-$^{D}$EvcPAB-G-NHCH2-Dxd]2 | −8.21 | $C_{150}H_{204}F_2N_{30}O_{46}$ | 3201.4 | 801.3 (M/4 + H), 1067.8 (M/3 + H) |
| LP30 | DIBAC-suc-B3-[NH-PEG2-$^{D}$EvcPAB-G-NHCH2-Dxd]2 | −3.41 | $C_{151}H_{187}F_2N_{27}O_{43}$ | 3106.3 | 786.4 (M/4 + H) (both ring-open); 781.8 (M/4 + H) (mono ring-open); 1036.2 (M/3 + H) (lactone) |
| LP31 | B3-[NH-PEG2-$^{L}$EvcPAB-G-NHCH2-Dxd]2 | −8.57 | $C_{132}H_{174}F_2N_{26}O_{41}$ | 2819.0 | 940.5 (M/3 + H) |
| LP32 | COT-B3-[NH-PEG2-$^{L}$EvcPAB-G-NHCH2-Dxd]2 | −4.15 | $C_{142}H_{186}F_2N_{26}O_{43}$ | 2983.2 | 995.5 (M/3 + H) |
| qLP33 | NH2-PEG3-TCOT-B3-[NH-PEG2-$^{L}$EvcPAB-G-NHCH2-Dxd]2 | −8.21 | $C_{150}H_{204}F_2N_{30}O_{46}$ | 3201.4 | 801.0 (M/4 + H) |
| LP34 | DIBAC-suc-B3-[NH-PEG2-$^{L}$EvcPAB-G-NHCH2-Dxd]2 | −3.41 | $C_{151}H_{187}F_2N_{27}O_{43}$ | 3106.3 | 786.5 (M/4 + H) (both ring-open), 1042.3 (M/3 + H) (mono ring-open), 1036.1 (M/3 + H) (lactone) |
| LP35 | COT-B3-[NH-PEG2-GGFG-NHCH2-Dxd]2 | −4.94 | $C_{120}H_{148}F_2N_{20}O_{33}$ | 2436.6 | 812.7 (M/3 + H) |
| LP36 | COT-B4-[NH-PEG2-$^{D}$EVCPAB-G-NHCH2-Dxd]2 | −3.59 | $C_{139}H_{179}F_2N_{25}O_{42}$ | 2910.1 | 970.8 (M/3 + H) |
| LP37 | COT-B4-[NH-PEG2-$^{L}$EVCPAB-G-NHCH2-Dxd]2 | −3.59 | $C_{139}H_{179}F_2N_{25}O_{42}$ | 2910.1 | 970.6 (M/3 + H) |
| LP38 | COT-PEG2-B4-[NH-PEG2-$^{L}$EVCPAB-G-NHCH2-Dxd]2 | −4.55 | $C_{150}H_{200}F_2N_{26}O_{47}$ | 3157.4 | 936.7 (M/3 + H) |
| LP39 | COT-PEG2-B4-[NH-$^{L}$EVCPAB-G-NHCH2-Dxd]2 | −2.63 | $C_{132}H_{166}F_2N_{24}O_{39}$ | 2750.9 | 917.3 (M/3 + H) |
| qLP40 | NH2-PEG3-TCOT-PEG2-B4-[NH-$^{L}$EVCPAB-G-NHCH2-Dxd]2 | −6.69 | $C_{140}H_{184}F_2N_{28}O_{42}$ | 2969.2 | 991.2 (M/3 + H) |
| LP41 | COT-PEG2-B5-[NH-PEG2-$^{L}$EVCPAB-G-NHCH2-Dxd]3 | −6.84 | $C_{210}H_{273}F_3N_{38}O_{65}$ | 4426.7 | 1107.6 (M/4 + H) |
| qLP42 | NH2-PEG3-TCOT-PEG2-B5-[NH-PEG2-$^{L}$EVCPAB-G-NHCH2-Dxd]3 | −11.22 | $C_{218}H_{291}F_3N_{42}O_{68}$ | 4644.9 | 929.7 (M/5 + H), 1161.9 (M/4 + H) |

Example 3: Synthesis of vcPAB-Carbamate Linker-Payloads

Linker-payloads LP1 and LP2 were synthesized as described in Scheme 2 and in Examples 3A-3C (for LP1) and 2D (for LP2), below. Starting materials L1-1 (CAS 2226472-26-8) and L2-3 (CAS 2226472-28-0) were synthesized according to WO2018089373A2, incorporated by reference herein in its entirety.

Scheme 2. Synthesis of vcPAB-carbamate linker-payloads
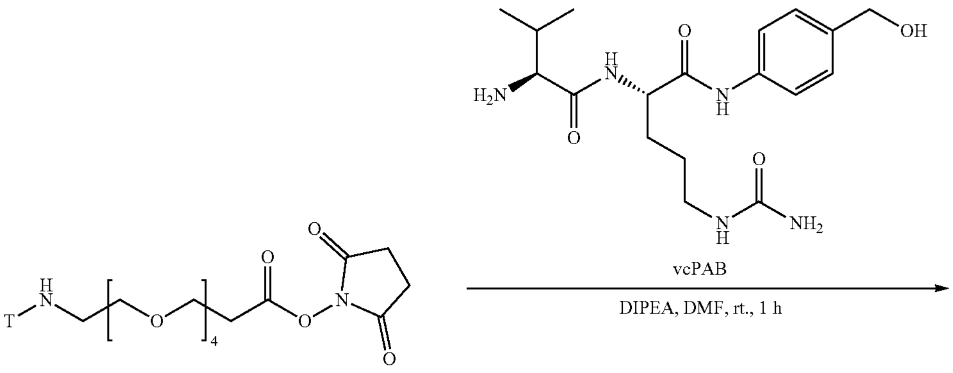
L1-1
L2-1
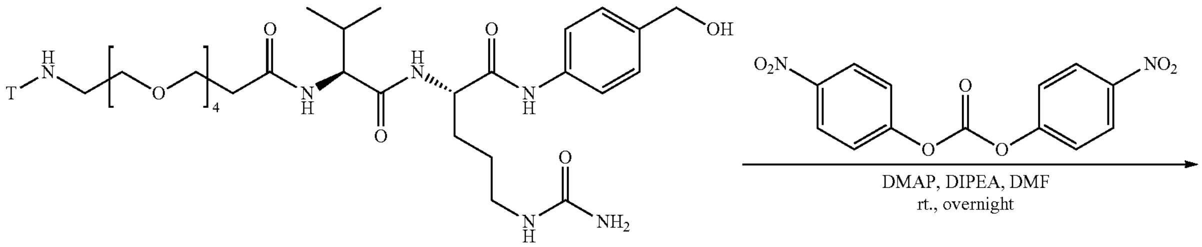
L1-2
L2-2
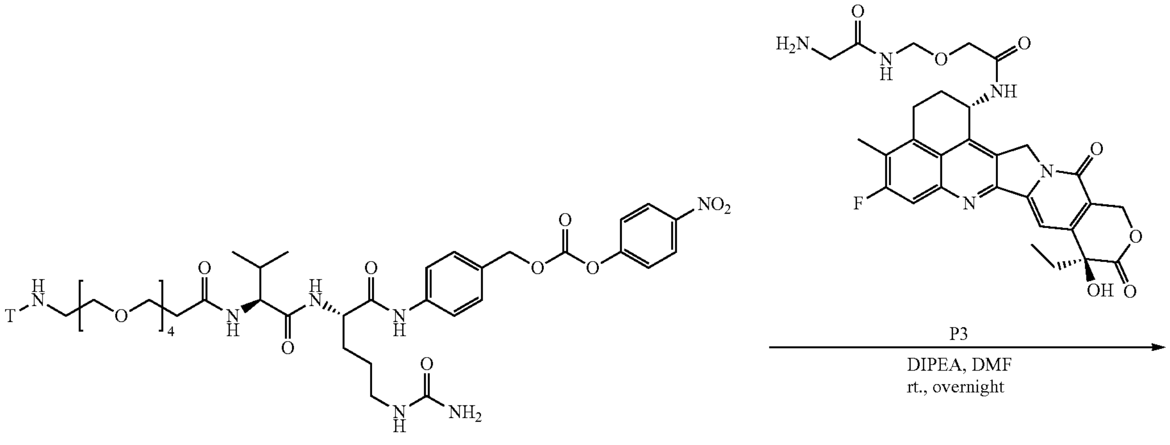
L1-3
L2-3

-continued

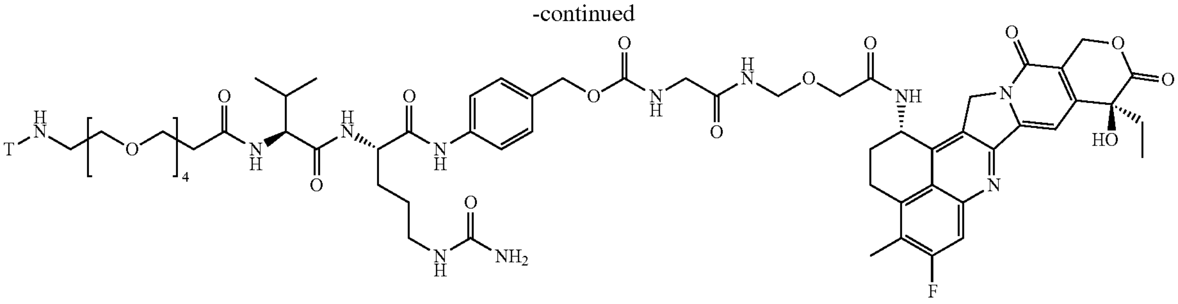

LP1
LP2

L1, LP1, T = 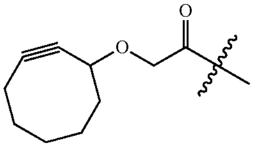

L2, LP2, T = 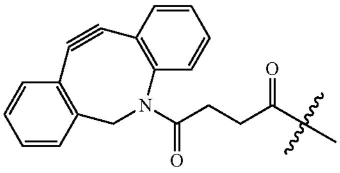

Example 3A: N-[(1S)-1-{[(1S)-4-(Carbamoylamino)-1-{[4-(hydroxymethyl)phenyl]carbamoyl}butyl]carbamoyl}-2-methylpropyl]-1-[2-(cyclooct-2-yn-1-yloxy)acetamido]-3,6,9,12-tetraoxapentadecan-15-amide (L1-2)

(L1-2)

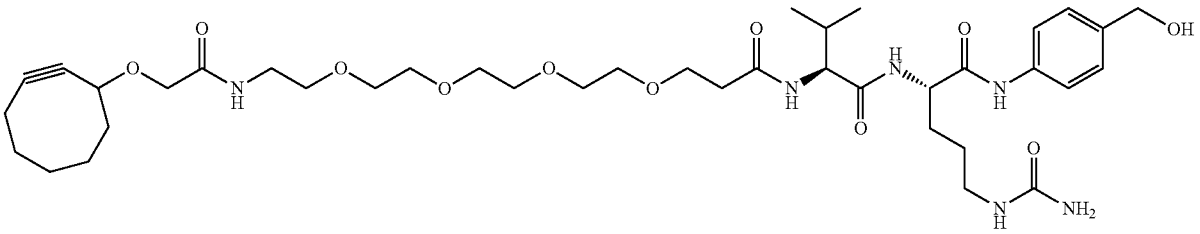

To a solution of compound L1-1 (0.17 g, 0.33 mmol) in DMF (10 mL) were added DIPEA (0.13 g, 1.0 mmol) and vcPAB (0.13 g, 0.34 mmol) successively, and the reaction mixture was stirred at RT for an hour. Reaction completion was monitored by LCMS. The resulting mixture was directly purified by reversed phase flash chromatography (0-80% acetonitrile in water) to give compound L1-2 (0.18 g, 70% yield) as a colorless oil. ESI m/z: 791.3 $(M+H)^+$. $^1H$ NMR (400 MHz, $DMSO_{d6}$) δ 9.91 (s, 1H), 8.11 (d, J=8.4 Hz, 1H), 7.89 (d, J=8.8 Hz, 1H), 7.61 (t, J=5.6 Hz, 1H), 7.55 (d, J=8.4 Hz, 2H), 7.23 (d, J=8.4 Hz, 2H), 5.98 (t, J=5.6 Hz, 1H), 5.42 (s, 2H), 5.10 (br s, 1H), 4.43 (s, 2H), 4.39-4.37 (m, 1H), 4.30-4.21 (m, 2H), 3.87 (d, J=14.8 Hz, 1H), 3.75 (d, J=14.8 Hz, 1H), 3.62-3.58 (m, 2H), 3.50-3.46 (m, 12H), 3.43 (t, J=6.0 Hz, 2H), 3.27-3.22 (m, 2H), 3.06-2.92 (m, 2H), 2.41-2.32 (m, 2H), 2.26-2.05 (m, 3H), 1.99-1.66 (m, 6H), 1.62-1.55 (m, 3H), 1.44-1.35 (m, 3H), 0.89 (d, J=6.8 Hz, 3H), 0.83 (d, J=6.8 Hz, 3H) ppm.

Example 3B: {4-[(2S)-5-(Carbamoylamino)-2-[(2S)-2-{1-[2-(cyclooct-2-yn-1-yloxy) acetamido]-3,6,9,12-tetraoxapentadecan-15-amido}-3-methylbutanamido]pentanamido]phenyl}methyl 4-nitrophenyl carbonate (L1-3)

(L1-3)

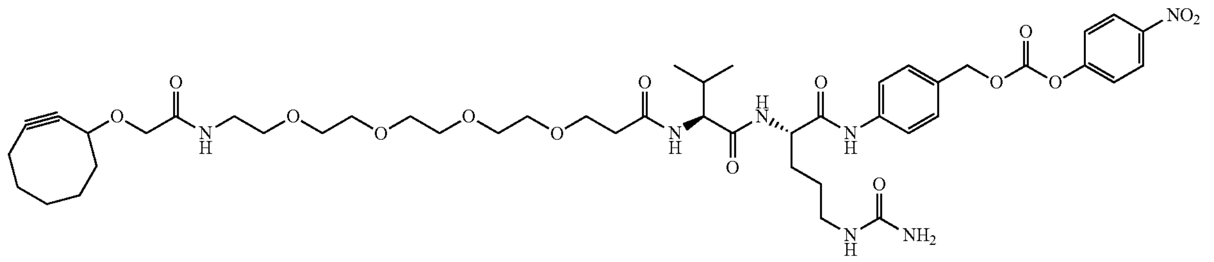

A suspension of compound L1-2 (80 mg, 0.10 mmol), DMAP (12 mg, 0.10 mmol) and DIPEA (26 mg, 0.20 mmol) in dry DMF (5 mL) was stirred at RT for 10 minutes before the addition of bis(4-nitrophenyl) carbonate (61 mg, 0.20 mmol). The reaction mixture was stirred at RT for 2 hours. Reaction completion was monitored by LCMS. The resulting mixture was directly purified by reversed phase flash chromatography (0-80% acetonitrile in water) to give compound L1-3 (53 mg, 55% yield) as a white solid. ESI m/z: 956.3 $(M+H)^+$.

Example 3C: {4-[(2S)-5-(Carbamoylamino)-2-[(2S)-2-{1-[2-(cyclooct-2-yn-1-yloxy)acetamido]-3,6,9,12-tetraoxapentadecan-15-amido}-3-methylbutanamido]pentanamido]phenyl}methyl N-({[({[(10S,23S)-10-ethyl-18-fluoro-10-hydroxy-19-methyl-5,9-dioxo-8-oxa-4,15-diazahexacyclo $[14.7.1.0^{2}, {}^{14}.0^{4}, {}^{13}.0^{6}, {}^{11}.0^{20}, {}^{24}]$tetracosa-1,6(11),12,14,16,18,20(24)-heptaen-23-yl] carbamoyl}methoxy)methyl]carbamoyl}methyl) carbamate (LP1)

(LP1)

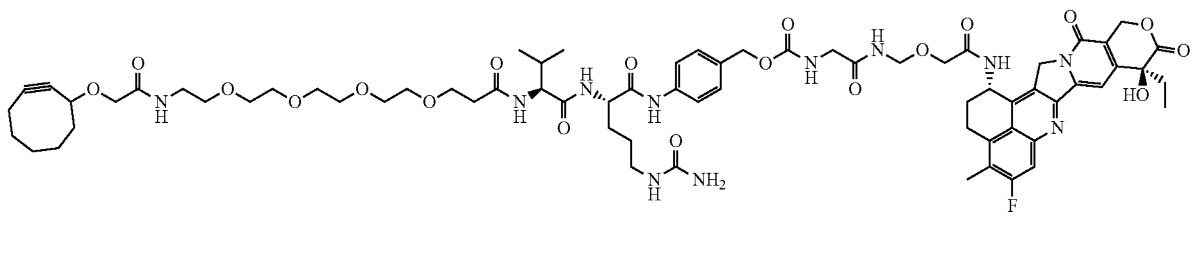

To a yellow solution of compound L1-3 (16 mg, 17 μmol) and P3 (12 mg, 17 μmol) in dry DMF (2 mL) was added DIPEA (6.5 mg, 51 μmol), and the clear reaction solution was stirred at RT for 2 hours. Reaction completion was monitored by LCMS. The resulting mixture was directly purified by reversed phase flash chromatography (0-60% acetonitrile in aq. TFA (0.01%)) to give linker-payload LP1 (15 mg, 63% yield as TFA salt) as a white solid. ESI m/z: 698.8 (M/2+H)+. 1H NMR (400 MHZ, DMSOd6) δ 9.99 (s, 1H), 8.80 (t, J=6.8 Hz, 1H), 8.50 (d, J=9.2 Hz, 1H), 8.12 (d, J=7.2 Hz, 1H), 7.87 (d, J=8.8 Hz, 1H), 7.79 (d, J=10.8 Hz, 1H), 7.62-7.58 (m, 3H), 7.42 (t, J=6.0 Hz, 1H), 7.31 (s, 1H), 7.28 (d, J=8.4 Hz, 2H), 6.53 (br s, 1H), 5.98 (t, J=5.2 Hz, 1H), 5.63-5.57 (m, 1H), 5.46-5.37 (m, 3H), 5.21 (s, 2H), 4.93 (s, 2H), 4.63 (d, J=6.4 Hz, 2H), 4.41-4.35 (m, 1H), 4.29-4.21 (m, 2H), 4.02 (s, 2H), 3.87 (d, J=14.4 Hz, 1H), 3.75 (d, J=14.8 Hz, 1H), 3.63-3.58 (m, 4H), 3.50-3.48 (m, 12H), 3.46-3.41 (m, 2H), 3.27-3.24 (m, 2H), 3.23-3.12 (m, 2H), 3.07-2.91 (m, 2H), 2.47-2.45 (m, 0.5H), 2.41-2.33 (m, 4.5H), 2.25-2.04 (m, 5H), 1.99-1.69 (m, 9H), 1.63-1.54 (m, 3H), 1.44-1.33 (m, 3H), 0.88-0.82 (m, 9H) ppm. (The proton of TFA was not observed). 19F NMR (376 MHZ, DMSOd6) δ −74 (TFA), −111 (Ar—F) ppm.

Example 3D: {4-[(2S)-2-[(2S)-2-[1-(4-{2-Azatricyclo[10.4.0.0$^{4}$, $^{9}$]hexadeca-1(12),4(9),5,7,13,15-hexaen-10-yn-2-yl}-4-oxobutanamido)-3,6,9,12-tetraoxapentadecan-15-amido]-3-methylbutanamido]-5-(carbamoylamino) pentanamido]phenyl}methyl N-({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24-heptaen-23-yl]carbamoyl}methoxy)methyl] carbamoyl}methyl)carbamate (LP2)

Lactone LP2: HPLC purity: 67%, retention time: 7.41 min, ESI m/z: 507.3 $(M/3+H)^+$, 760.5 $(M/2+H)^+$; Ring-opening product LP2-RO: HPLC purity: 33%, retention time: 6.61 min, ESI m/z: 513.3 $(M/3+H)^+$, 769.5 $(M/2+H)^+$.

Lactone product and ring-opening product mixture 1H NMR (400 MHz, DMSO$_{d6}$) δ 9.99 (s, 1H), 8.80 (t, J=6.4 Hz, 1H), 8.50 (d, J=8.8 Hz, 1H), 8.12 (d, J=7.2 Hz, 1H), 7.87 (d, J=8.4 Hz, 1H), 7.80-7.75 (m. 2H), 7.69-7.67 (m, 1H), 7.63-7.58 (m, 3H), 7.51-7.46 (m, 3H), 7.45-7.33 (m, 3H), 7.32-7.26 (m, 4H), 6.53 (s, 1H), 5.98 (t, J=6.0 Hz, 1H), 5.63-5.57 (m, 1H), 5.42 (s, 4H), 5.21 (s, 2H), 5.03 (d, J=14.0 Hz, 1H), 4.93 (s, 2H), 4.63 (d, J=6.8 Hz, 2H), 4.41-4.35 (m, 1H), 4.25-4.21 (m, 1H), 4.02 (s, 2H), 3.62-3.57 (m, 5H), 3.48-3.45 (m, 12H), 3.31-3.28 (m, 2H), 3.23-3.14 (m, 2H), 3.11-3.07 (m, 2H), 3.05-2.98 (m, 1H), 2.96-2.91 (m, 1H), 2.60-2.55 (m, 1H), 2.46-2.44 (m, 1H), 2.39 (s, 3H), 2.35-2.33 (m, 1H), 2.26-2.15 (m, 3H), 2.03-1.94 (m, 2H), 1.88-1.67 (m, 4H), 1.63-1.57 (m, 1H), 1.46-1.33 (m, 2H), 0.88-0.81 (m, 9H) ppm. $^{19}$F NMR (376 MHz, DMSO$_{d6}$) δ −111 ppm.

(LP2)

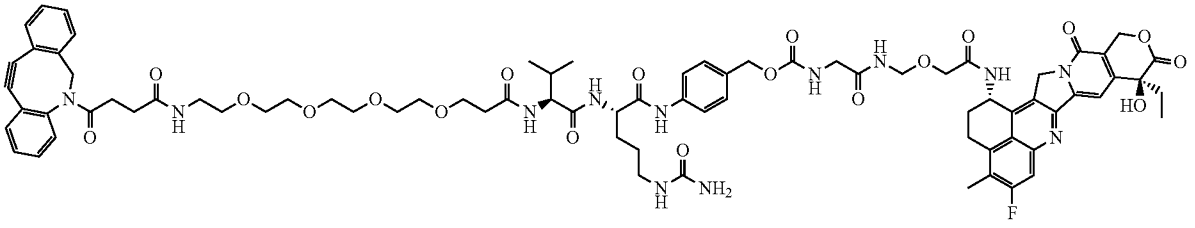

Following the procedure to make LP1 except substituting L2-3 for L1-3, linker-payload LP2 (12 mg, 46% yield) was obtained as a mixture of the lactone product (LP2, pictured above) and the ring-opening product (LP2-RO, pictured below) as a white solid after purification by reversed phase flash chromatography (0-100% methanol in aq. ammonium bicarbonate (10 mM)).

Linker-payloads LP16 and LP17 were synthesized as described in Scheme 3 and in Examples 3E-3F (for LP16) and 3G (for LP17), below.

(LP2-RO)

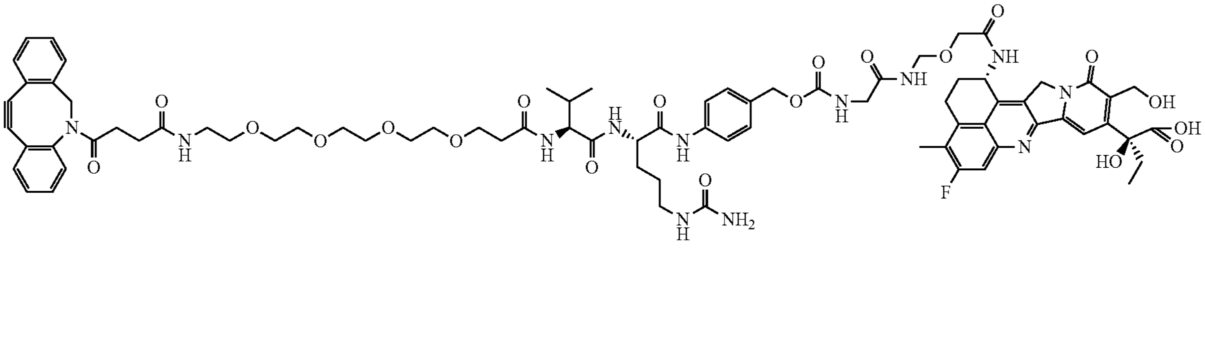

Scheme 3. Synthesis of LP16 and LP17.
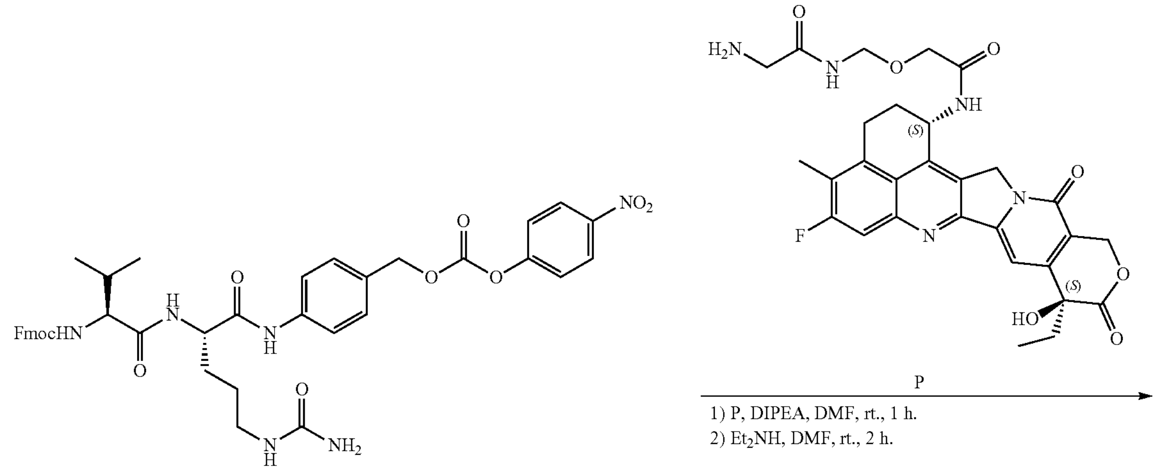
Fmoc-vcPAB-PNP
863971-53-3
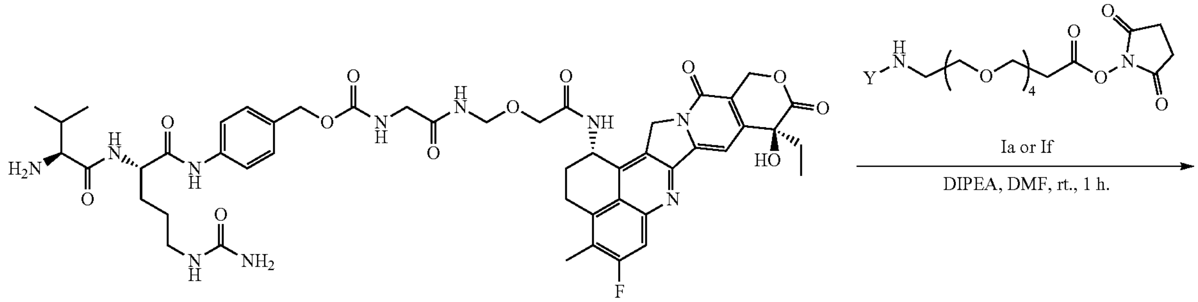
LP16-1
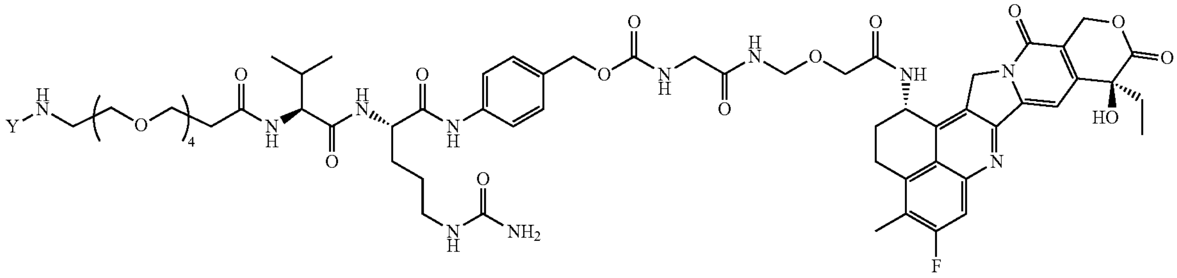
$Et_2NH$, DMF
rt., 1 h.
LP16f, Y = Fmoc
LP16, Y = H
LP24, Y =
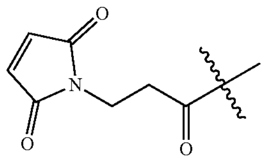

Example 3E: {4-[(2S)-2-[(2S)-2-Amino-3-methylbutanamido]-5-(carbamoylamino)pentanamido]phenyl}methyl N-({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl) carbamate (LP16-1)

(LP16-1)

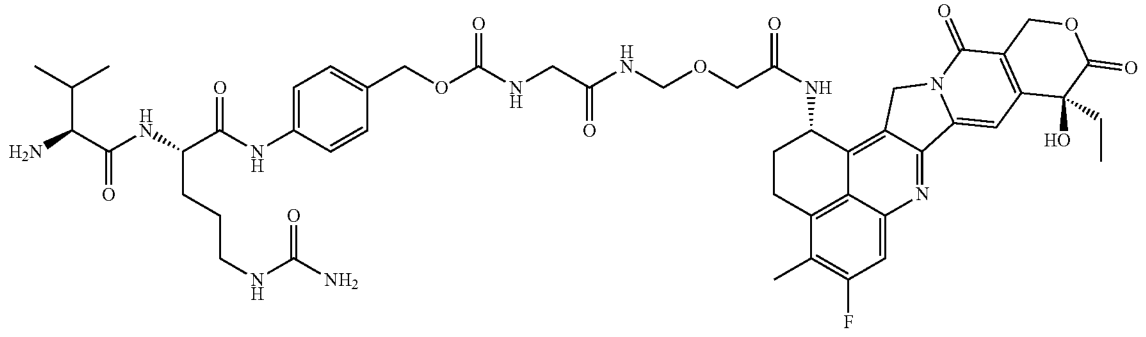

To a solution of payload P3 (0.11 g, 0.15 mmol) in DMF (2 mL) were added DIPEA (39 mg, 0.30 mmol) and Fmoc-vcPAB-PNP (CAS: 863971-53-3, 77 mg, 0.10 mmol), and the reaction mixture was stirred at room temperature for an hour until the mixture turned clear and P was totally consumed according to LCMS. The resulting solution was separated by reversed phase flash chromatography (0-70% acetonitrile in aq. TFA (0.01%)) to give Fmoc-LP16-1 (98 mg, ESI m/z: 494 $(M_{DXD}+H)^+$, 714.2 $(M-M_{DXD}+H)^+$ as a light yellow solid, which was dissolved in dry DMF (4.5 mL). To the solution was added diethylamine (0.5 mL) slowly, and the reaction mixture was stirred at room temperature for 2 hours until Fmoc was totally removed according to LCMS. The volatiles were removed in vacuo and the residue was purified by reversed phase flash chromatography (0-40% acetonitrile in aq. TFA (0.01%)) to give LP16-1 (TFA salt, 45 mg, 41% yield from P3). ESI m/z: 493.1 $(M/2+H)^+$. $^1$H NMR (400 MHz, $DMSO_{d6}$) δ 10.20 (s, 1H), 8.80 (t, J=6.8 Hz, 1H), 8.68 (d, J=7.6 Hz, 1H), 8.50 (d, J=8.8 Hz, 1H), 8.09-8.01 (m, 3H), 7.79 (d, J=10.8 Hz, 1H), 7.58 (d, J=8.4 Hz, 2H), 7.41 (t, J=6.0 Hz, 1H), 7.31 (s, 1H), 7.29 (d, J=8.4 Hz, 2H), 6.53 (s, 1H), 6.05 (t, J=5.6 Hz, 1H), 5.63-5.57 (m, 1H), 5.54-5.45 (m, 2H), 5.42-5.41 (m, 2H), 5.21 (s, 2H), 4.93 (s, 2H), 4.63 (d, J=6.4 Hz, 2H), 4.55-4.50 (m, 1H), 4.02 (s, 2H), 3.69-3.61 (m, 3H), 3.24-3.12 (m, 1H), 3.08-2.94 (m, 2H), 2.40 (s, 3H), 2.23-2.18 (m, 2H), 2.14-2.03 (m, 1H), 1.90-1.81 (m, 2H), 1.78-1.68 (m, 1H), 1.64-1.53 (m, 1H), 1.47-1.36 (m, 2H), 0.96 (d, J=3.2 Hz, 3H), 0.94 (d, J=3.2 Hz, 3H), 0.87 (t, J=7.6 Hz, 3H) ppm. (Proton of TFA was not revealed.) $^{19}$F NMR (376 MHz, $DMSO_{d6}$) δ at −111, −73 ppm.

Example 3F: {4-[(2S)-2-[(2S)-2-(1-Amino-3,6,9,12-tetraoxapentadecan-15-amido)-3-methylbutanamido]-5-(carbamoylamino)pentanamido]phenyl}methyl N-({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamate (LP16)

(LP16)

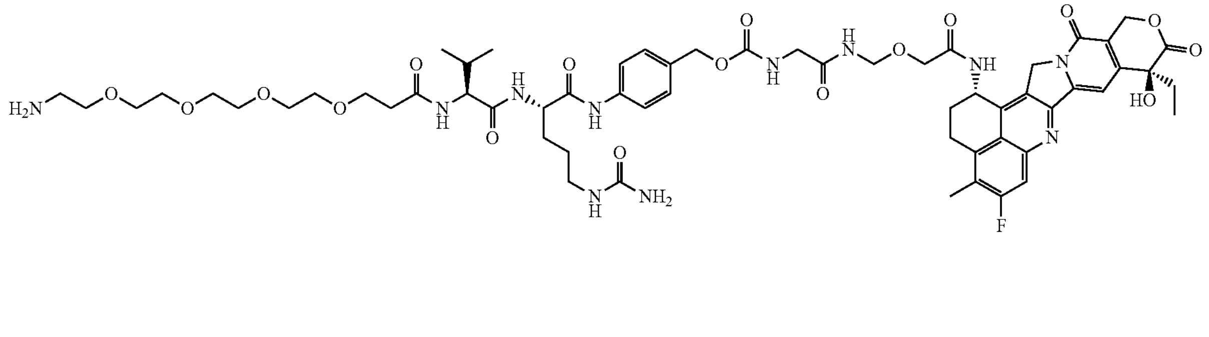

To a solution of LP16-1 (16 mg, 15 μmol) in anhydrous DMF (1 mL) was added DIPEA (4 mg, 29 μmol) until pH value between 8.0 and 9.0, and then a solution of compound If (CAS 1314378-14-7, 9 mg, 15 μmol) in anhydrous DMF (1 mL) was added into the reaction solution. The mixture was stirred at room temperature for an hour until starting materials were totally consumed according to LCMS. The resulting solution was separated by reversed phase flash chromatography (0-100% acetonitrile in aq. TFA (0.01%)) to give LP16f (18 mg, ESI m/z: 728.3 $(M/2+H)^+$) as a white solid, which was dissolved in anhydrous DMF (1.9 mL). To the solution was added diethylamine (0.1 mL), and the yellow reaction solution was stirred at room temperature for half an hour until Fmoc was totally removed according to LCMS. The resulting solution was concentrated in vacuo and the residue was purified by prep-HPLC (10-95% acetonitrile in aq. formic acid (0.01%)) to give linker-payload LP16 (6 mg, 34% yield) as a light yellow solid. ESI m/z: 616.9 $(M/2+H)^+$. $^1$H NMR (400 MHz, $DMSO_{d6}$) δ 10.03 (s, 1H), 8.80 (d, J=6.8 Hz, 1H), 8.51 (d, J=9.2 Hz, 1H), 8.41 (s, 1H), 8.15 (d, J=6.8 Hz, 1H), 7.90 (d, J=8.8 Hz, 1H), 7.79 (d, J=6.8 Hz, 1H), 7.60 (d, J=8.0 Hz, 2H), 7.42 (t, J=6.4 Hz, 1H), 7.32 (s, 1H), 7.27 (d, J=8.0 Hz, 2H), 6.56-6.50 (m, 1H), 6.05-6.01 (m, 1H), 5.63-5.58 (m, 1H), 5.43 (s, 4H), 5.21 (s, 2H), 4.93 (s, 2H), 4.63 (d, J=6.8 Hz, 2H), 4.42-4.35 (m, 1H), 4.23 (t, J=7.6 Hz, 1H), 4.02 (s, 2H), 3.63-3.58 (m, 4H), 3.53-3.49 (m, 12H), 3.46-3.43 (m, 2H), 3.18-3.15 (m, 2H), 3.06-2.93 (m, 2H), 2.79-2.76 (m, 2H), 2.42-2.36 (m, 5H), 2.24-2.12 (m, 2H), 2.03-1.93 (m, 1H), 1.89-1.81 (m, 2H), 1.74-1.65 (m, 1H), 1.65-1.54 (m, 1H), 1.48-1.31 (m, 3H), 0.89-0.82 (m, 9H) ppm. $^{19}$F NMR (400 MHz, $DMSO_{d6}$) δ −111 ppm.

Example 3G: {4-[(2S)-5-(Carbamoylamino)-2-[(2S)-2-{1-[3-(2,5-dioxo-2,5-dihydro-1H-pyrrol-1-yl)propanamido]-3,6,9,12-tetraoxapentadecan-15-amido}-3-methylbutanamido]pentanamido]phenyl}methyl N-({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl) carbamate (LP17)

To a yellow solution of LP16-1 (30 mg, 30 μmol) in anhydrous DMF (1.5 mL) were added DIPEA (8 mg, 62 μmol) and Ia (CAS: 756525-99-2, commercial, 16 ng, 30 μmol), and the reaction mixture was stirred at room temperature for an hour until starting materials were totally consumed according to LCMS. The resulting mixture was directly purified by prep-HPLC (0-100% acetonitrile in aq. TFA (0.05%)) to give LP17 (TFA salt, 15 mg, 38% yield) as a light yellow solid. ESI m/z: 692.4 (M/2+H). $^1$H NMR (400 MHz, $DMSO_{d6}$) δ 9.99 (s, 1H), 8.79 (t, J=6.8 Hz, 1H), 8.50 (d, J=8.4 Hz, 1H), 8.11 (d, J=8.0 Hz, 1H), 8.02 (t, J=6.0 Hz, 1H), 7.87 (d, J=8.8 Hz, 1H), 7.79 (d, J=10.8 Hz, 1H), 7.59 (d, J=8.4 Hz, 2H), 7.41 (t, J=6.0 Hz, 1H), 7.32 (s, 1H), 7.28 (d, J=8.4 Hz, 2H), 7.00 (s, 2H), 6.52 (br s, 1H), 5.98 (t, J=6.0 Hz, 1H), 5.63-5.57 (m, 1H), 5.43-5.41 (m, 4H), 5.21 (s, 2H), 4.93 (s, 2H), 4.63 (d, J=6.8 Hz, 2H), 4.43-4.34 (m, 1H), 4.25-4.21 (m, 1H), 4.02 (s, 2H), 3.61-3.57 (m, 6H), 3.49-3.48 (m, 12H), 3.21-3.12 (m, 4H), 3.05-2.91 (m, 4H), 2.49-2.39 (m, 5H), 2.33 (t, J=7.2 Hz, 2H), 2.22-2.14 (m, 2H), 2.02-1.94 (m, 1H), 1.89-1.80 (m, 2H), 1.75-1.65 (m, 1H), 1.65-1.54 (m, 1H), 1.49-1.32 (m, 2H), 0.87-0.82 (m, 9H) ppm. (Proton of TFA was not revealed.) $^{19}$F NMR (376 MHz, $DMSO_{d6}$) δ −111, −73 ppm.

Linker-payloads LP1, LP2, LP13, LP14, LP15, LP19, LP20, LP21, and LP22 were synthesized as described in Scheme 4 and in Examples 3H-3AR, below.

(LP17)

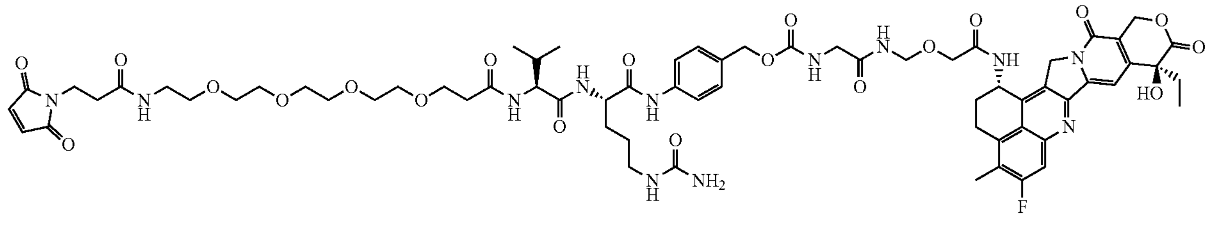

Scheme 4. Synthesis of linear vcPAB-Linker-P3 LP1, LP2, LP13-LP15, and LP19-LP22
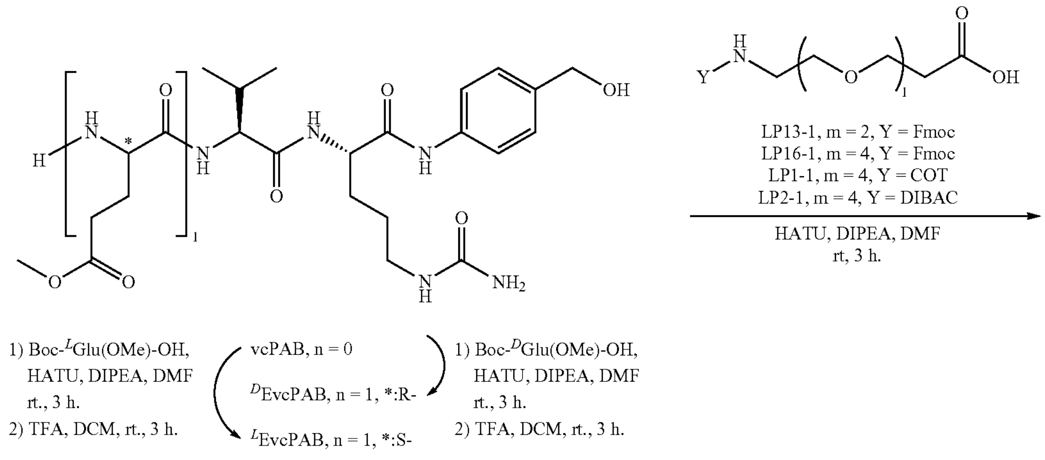
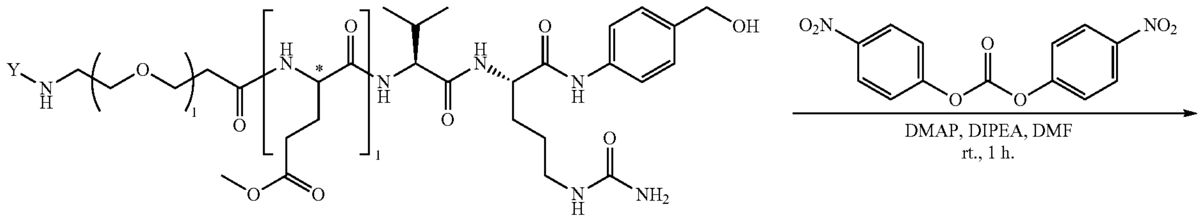
LP13-2, n = 0, m = 2, Y = Fmoc
LP14-2, n = 1, *:R-, m = 2, Y = Fmoc
LP15-2, n = 1, *:S-, m = 2, Y = Fmoc
LP1-2, n = 0, m = 4, Y = COT
LP2-2, n = 0, m = 4, Y = DIBAC
LP19-2, n = 1, *:R-, m = 4, Y = Fmoc
LP20-2, n = 1, *:R-, m = 4, Y = COT
LP21-2, n = 1, *:S-, m = 4, Y = Fmoc
LP22-2, n = 1, *:S-, m = 4, Y = COT
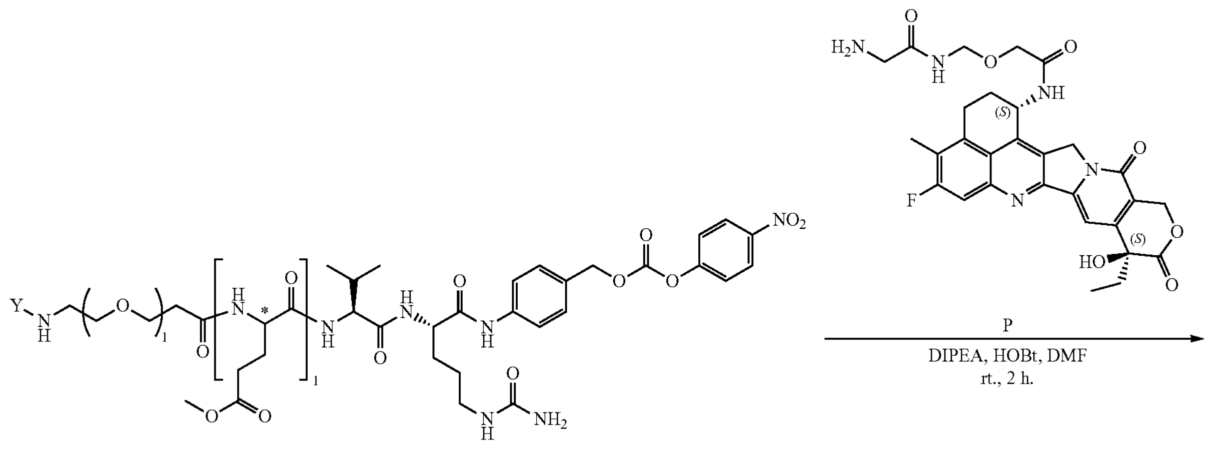
LP#-3

-continued
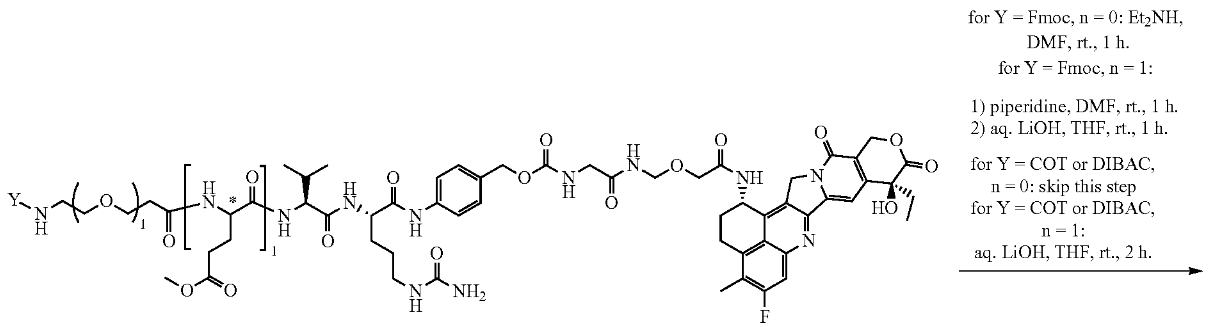
LP#-4
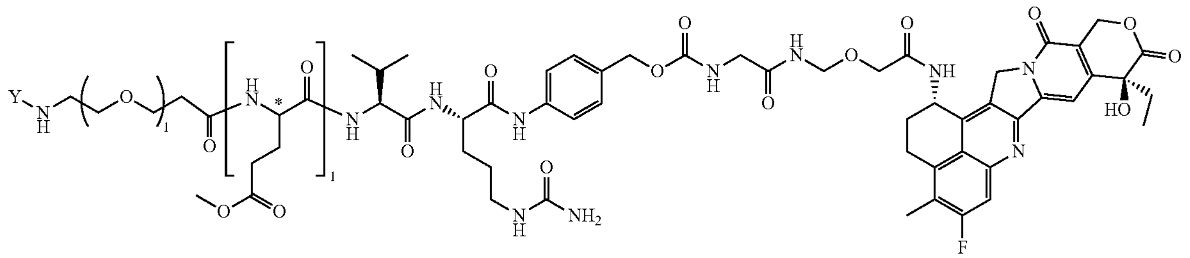
LP13, n = 0, m = 2, Y = H
LP14, n = 1, *:R-, m = 2, Y = H
LP15, n = 1, *:S-, m = 2, Y = H
LP1, n = 0, m = 4, Y = COT
LP2, n = 0, m = 4, Y = DIBAC
LP19, n = 1, *:R-, m = 4, Y = H
LP20, n = 1, *:R-, m = 4, Y = COT
LP21, n = 1, *:S-, m = 4, Y = H
LP22, n = 1, *:S-, m = 4, Y = COT
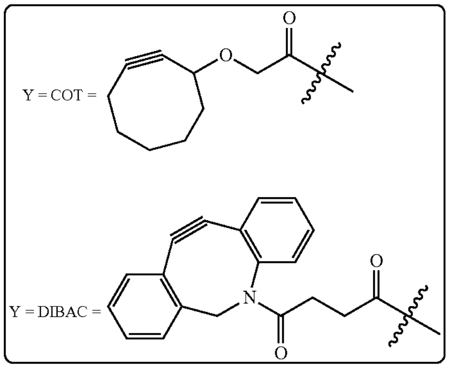

Example 3H: Methyl (4R)-4-amino-4-{[(1S)-1-{[(1S)-4-(carbamoylamino)-1-{[4-(hydroxymethyl)phenyl]carbamoyl}butyl]carbamoyl}-2-methylpropyl]carbamoyl}butanoate ($^{D}$EvcPAB)

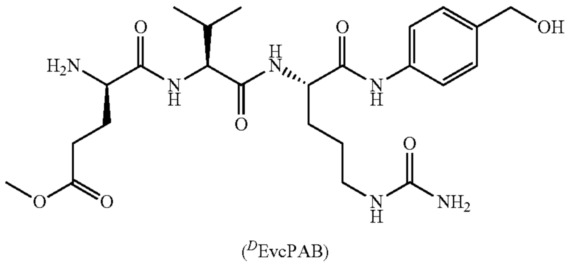 [SMILES: COC(=O)CC[C@@H](N)C(=O)N[C@H](C(=O)N[C@@H](CCCNC(N)=O)C(=O)Nc1ccc(CO)cc1)C(C)C]

($^{D}$EvcPAB)

To a solution of vcPAB (0.25 g, 0.95 mmol) in DMF (3 mL) were added DIPEA (0.37 g, 2.9 mmol) and HATU (0.25 g, 0.95 mmol), and the mixture was stirred at room temperature for 10 minutes before the addition of Boc-DGlu(OMe)-OH (0.40 g, 1.1 mmol). The reaction mixture was stirred at room temperature for 3 hours, which was monitored by LCMS. The resulting mixture was purified by reversed phase flash chromatography (0-70% acetonitrile in water) to give Boc-DEvcPAB (0.35 g, ESI m/z: 623.4 $(M+H)^+$) as a white solid, which was dissolved in DCM (5 mL). To the solution was added TFA (1.5 mL), and the reaction mixture was stirred at room temperature for 3 hours until Boc was totally removed, which was monitored by LCMS. The volatiles were removed in vacuo and the residue was purified by reversed phase flash chromatography (10-40% acetonitrile in water) to give $^{D}$EvcPAB (0.27 g, 48% yield) as a white solid. ESI m/z: 523.4 $(M+H)^+$.

Example 3I: Methyl (4S)-4-amino-4-{[(1S)-1-{[(1S)-4-(carbamoylamino)-1-{[4-(hydroxymethyl)phenyl]carbamoyl}butyl]carbamoyl}-2-methylpropyl]carbamoyl}butanoate ($^{L}$EvcPAB)

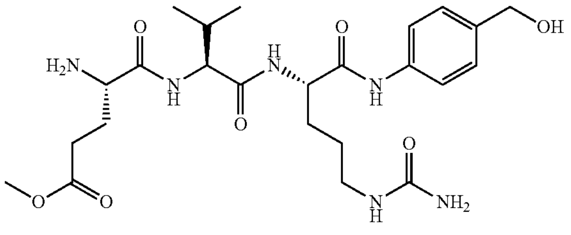

($^{L}$EvcPAB)

Following the similar procedure as DEvcPAB except using Boc-LGlu(OMe)-OH instead of Boc-DGlu(OMe)-OH, intermediate $^{L}$EvcPAB (0.18 g, 49% yield) was obtained as a light yellow solid. ESI m/z: 523.3 (M+H)+, 545.3 $(M+Na)^+$.

Example 3J: General Procedure for LP #-2 and Synthesis of LP13-2, LP16-2, LP1-2, and LP2-2

To a solution of LP13-1, LP16-1, LP1-1 or LP2-1 (1.0 equiv.) in DMF (0.25 mM) were added DIPEA (3.3 equiv.) and HATU (1.0 equiv.), and the mixture was stirred at room temperature or 10 minutes before the addition of vcPAB or EvcPAB (1.1-1.5 equiv.). The reaction mixture was stirred at room temperature for 3 hours, which was monitored by LCMS. The resulting mixture was directly purified by reversed phase flash chromatography (0-100% acetonitrile in water) to give linker LP #-2 (LP13-2, LP16-2, LP1-2, or LP2-2) as a white solid.

Example 3K: (9H-Fluoren-9-yl)methyl N-{2-[2-(2-{[(1S)-1-{[(1S)-4-(carbamoylamino)-1-{[4-(hydroxymethyl)phenyl]carbamoyl}butyl]carbamoyl}-2-methylpropyl]carbamoyl}ethoxy)ethoxy]ethyl}carbamate (LP13-2)

(LP13-2)

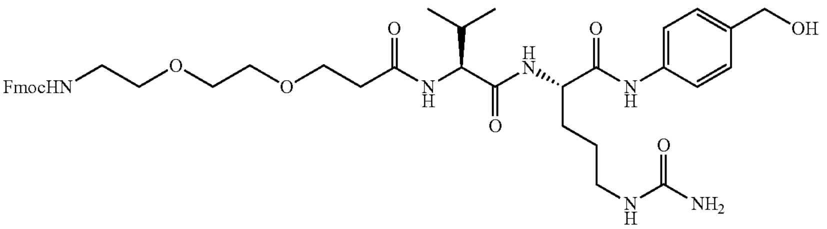

Following the general procedure using vcPAB (0.85 g, 2.2 mmol) and LP13-1 (0.60 g, 1.5 mmol), compound LP13-2 (1.0 g, 87% yield) was obtained as a white solid. ESI m/z: 761.3 $(M+H)^+$, 783.3 $(M+Na)^+$.

Example 3L: Methyl (4R)-4-{[(1S)-1-{[(1S)-4-(carbamoylamino)-1-{[4-(hydroxymethyl)phenyl]carbamoyl}butyl]carbamoyl}-2-methylpropyl]carbamoyl}-4-(3-{2-[2-({[(9H-fluoren-9-yl)methoxy]carbonyl}amino)ethoxy]ethoxy}propanamido)butanoate (LP14-2)

(LP14-2)

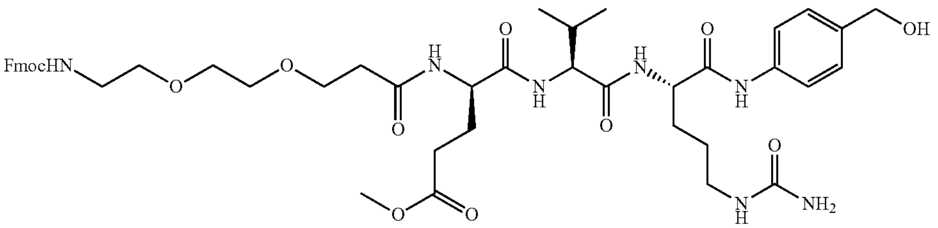

Following the general procedure starting from LP14-1 (0.19 g, 0.37 mmol) and DEvcPAB (0.14 g, 0.34 mmol), linker LP14-2 (0.20 g, 66% yield) was obtained as a white solid after purification by reversed phase flash chromatography (0-70% acetonitrile in water). ESI m/z: 904.4 $(M+H)^+$.

Example 3M: Methyl (4S)-4-{[(1S)-1-{[(1S)-4-(carbamoylamino)-1-{[4-(hydroxymethyl)phenyl]carbamoyl}butyl]carbamoyl}-2-methylpropyl]carbamoyl}-4-(3-{2-[2-({[(9H-fluoren-9-yl)methoxy]carbonyl}amino)ethoxy]ethoxy}propanamido)butanoate (LP15-2)

(LP15-2)

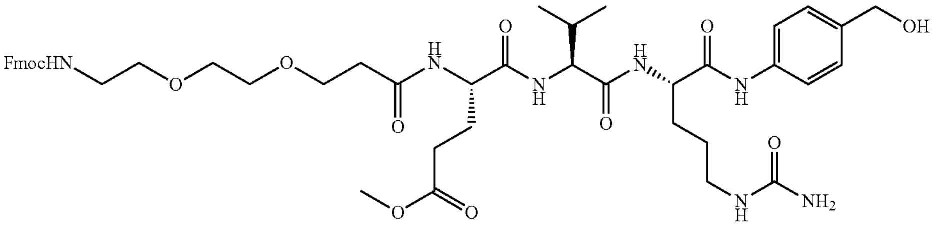

Following the general procedure starting from LP13-1 (0.45 g, 1.1 mmol) and $^{L}$EvcPAB (0.65 g, 1.2 mmol), linker LP15-2 (0.70 g, 69% yield) was obtained as a white solid after purification by reversed phase flash chromatography (0-100% acetonitrile in water). ESI m/z: 904.5 $(M+H)^+$. $^1$H NMR (400 MHz, $DMSO_{d6}$) δ 9.94 (s, 1H), 8.15-8.07 (m, 2H), 7.91-7.87 (m, 2H), 7.78 (d, J=8.8 Hz, 1H), 7.69 (d, J=7.2 Hz, 2H), 7.55-7.52 (m, 2H), 7.41 (t, J=7.6 Hz, 2H), 7.35-7.30 (m, 3H), 7.23 (d, J=8.4 Hz, 2H), 6.00-5.93 (m, 1H), 5.42 (bs, 1H), 4.42 (s, 2H), 4.39-4.34 (m, 2H), 4.31-4.27 (m, 2H), 4.24-4.16 (m, 2H), 3.60-3.56 (m, 5H), 3.47 (s, 3H), 3.36-3.34 (m, 2H), 3.14-3.10 (m, 2H), 3.04-3.00 (m, 1H), 2.96-2.91 (m, 1H), 2.44-2.38 (m, 2H), 2.35-2.29 (m, 4H), 2.00-1.95 (m, 1H), 1.92-1.86 (m, 1H), 1.77-1.66 (m, 2H), 1.61-1.55 (m, 1H), 1.46-1.34 (m, 2H), 1.25-1.18 (m, 1H), 0.87-0.80 (m, 6H) ppm.

Example 3N: N-[(1S)-1-{[(1S)-4-(Carbamoylamino)-1-{[4-(hydroxymethyl) phenyl]carbamoyl}butyl]carbamoyl}-2-methylpropyl]-1-[2-(cyclooct-2-yn-1-yloxy)acetamido]-3,6,9,12-tetraoxapentadecan-15-amide (LP1-2)

(LP1-2)

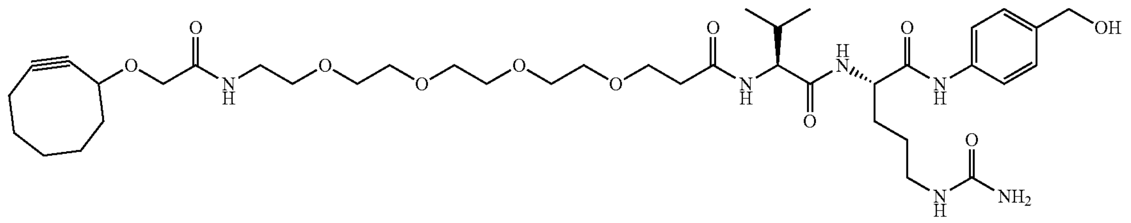

Following the general procedure starting from LP1-1 and vcPAB (3.3 g, 8.0 mmol), linker LP1-2 (4.3 g, 68% yield) was obtained as a white solid after purification by reversed phase flash chromatography (0-100% acetonitrile in water). ESI m/z: 791.5 $(M+H)^+$.

Example 3O: Methyl (4R)-4-{[(1S)-1-{[(1S)-4-(carbamoylamino)-1-{[4-(hydroxymethyl)phenyl]carbamoyl}butyl]carbamoyl}-2-methylpropyl]carbamoyl}-4-[1-({[(9H-fluoren-9-yl)methoxy]carbonyl}amino)-3,6,9,12-tetraoxapentadecan-15-amido]butanoate (LP19-2)

(L19-2)

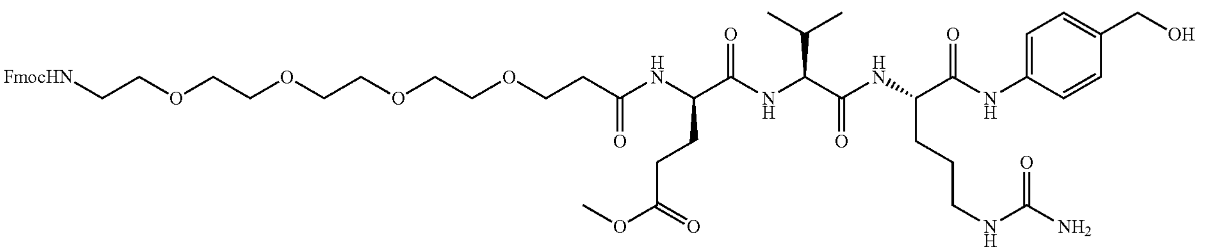

Following the general procedure starting from DEvcPAB (0.17 g, 0.34 mmol) and LP16-1 (0.17 g, 0.34 mmol), linker LP19-2 (0.18 g, 53% yield) was obtained as a light yellow solid. ESI m/z: 993.5 $(M+H)^+$.

Example 3P: Methyl (4R)-4-{[(1S)-1-{[(1S)-4-(carbamoylamino)-1-{[4-(hydroxymethyl)phenyl]carbamoyl}butyl]carbamoyl}-2-methylpropyl]carbamoyl}-4-{1-[2-(cyclooct-2-yn-1-yloxy) acetamido]-3,6,9,12-tetraoxapentadecan-15-amido}butanoate (LP20-2)

(LP20-2)

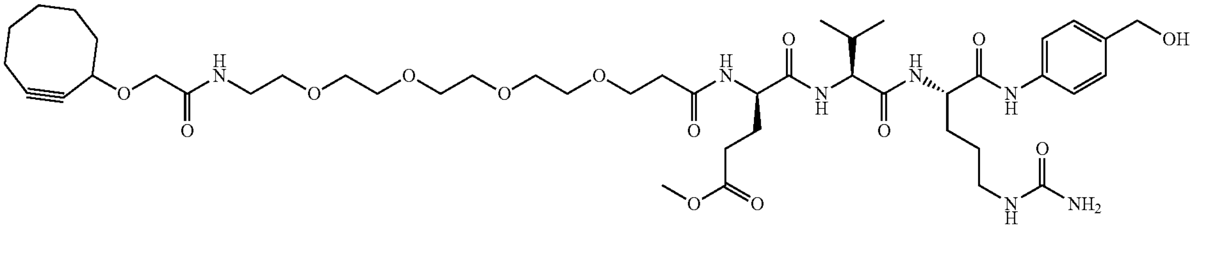

Following the general procedure starting from $^{D}$EvcPAB (0.28 g, 0.54 mmol) and LP1-1 (0.25 g, 0.48 mmol), compound LP20-2 (0.20 g, 44% yield) was obtained as a light yellow solid. ESI m/z: 934.5 $(M+H)^+$.

Example 3Q: Methyl (4S)-4-{[(1S)-1-{[(1S)-4-(carbamoylamino)-1-{[4-(hydroxymethyl)phenyl]carbamoyl}butyl]carbamoyl}-2-methylpropyl]carbamoyl}-4-[1-({[(9H-fluoren-9-yl)methoxy]carbonyl}amino)-3,6,9,12-tetraoxapentadecan-15-amido]butanoate (LP21-2)

(LP21-2)

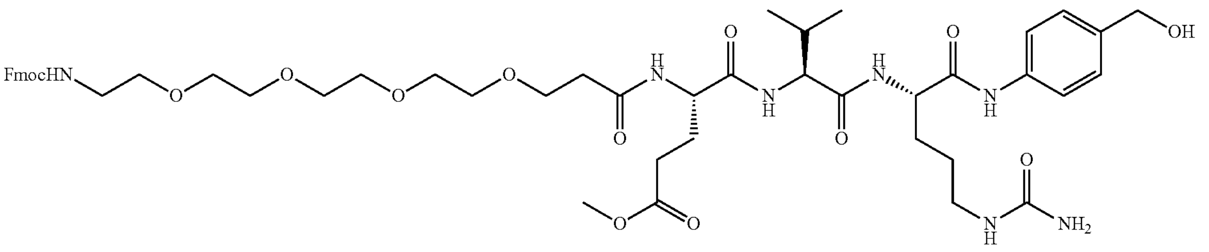

Following the general procedure starting from $^{L}$EvcPAB (0.20 g, 0.38 mmol) and LP16-1 (0.19 g, 0.39 mmol), compound LP21-2 (0.20 g, 53% yield) was obtained as a white solid. ESI m/z: 992.5 $(M+H)^+$. $^1$H NMR (400 MHz, $DMSO_{d6}$) δ 9.94 (s, 1H), 8.13 (d, J=7.2 Hz, 1H), 8.08 (d, J=7.6 Hz, 1H), 7.89 (d, J=7.2 Hz, 2H), 7.77 (d, J=8.4 Hz, 1H), 7.70 (d, J=7.6 Hz, 2H), 7.54 (d, J=8.4 Hz, 2H), 7.44-7.39 (m, 2H), 7.35-7.31 (m, 3H), 7.23 (d, J=8.4 Hz, 2H), 5.98 (brs, 1H), 5.41 (br s, 1H), 4.43 (s, 2H), 4.39-4.33 (m, 2H), 4.31-4.29 (m, 2H), 4.23-4.17 (m, 2H), 3.63-3.57 (m, 6H), 3.50-3.46 (m, 12H), 3.41 (t, J=6.0 Hz, 2H), 3.16-3.10 (m, 2H), 3.10-3.00 (m, 1H), 2.99-2.89 (m, 1H), 2.40-2.30 (m, 4H), 2.02-1.87 (m, 2H), 1.78-1.55 (m, 3H), 1.48-1.32 (m, 2H), 0.86 (d, J=6.8 Hz, 3H), 0.83 (d, J=6.8 Hz, 3H) ppm. (proton of benzyl alcohol was not revealed.)

Example 3R: Methyl (45)-4-{[(1S)-1-{[(1S)-4-(carbamoylamino)-1-{[4-(hydroxymethyl)phenyl]carbamoyl}butyl]carbamoyl}-2-methylpropyl]carbamoyl}-4-{1-[2-(cyclooct-2-yn-1-yloxy)acetamido]-3,6,9,12-tetraoxapentadecan-15-amido}butanoate (LP22-2)

(LP22-2)

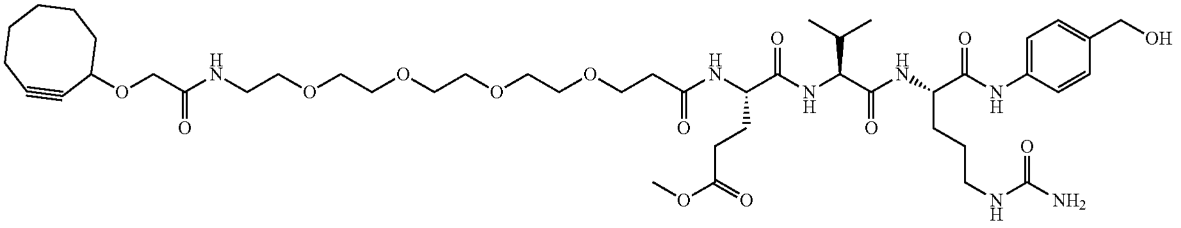

Following the general procedure starting from $^{L}$EvcPAB (0.10 g, 0.19 mmol) and LP1-1 (81 mg, 0.19 mmol), compound LP22-2 (0.11 g, 63% yield) was obtained as a white solid. ESI m/z: 934.5 $(M+H)^+$.

Example 3S: General Procedure for LP #-3

To a solution of LP #-2 (1.0 equiv.) in DMF (0.15 mM) were added DMAP (1.0 equiv.), DIPEA (3.0 equiv.) and bis(4-nitrophenyl) carbonate (3.0 equiv.), and the reaction mixture was stirred at room temperature for an hour, which was monitored by LCMS. The resulting mixture was purified by reversed phase flash chromatography (0-60% acetonitrile in water) to give LP #-3 as light yellow oil.

Example 3T: {4-[(2S)-5-(Carbamoylamino)-2-[(2S)-2-(3-{2-[2-({[(9H-fluoren-9-yl)methoxy]carbonyl}amino)ethoxy]ethoxy}propanamido)-3-methylbutanamido]pentanamido]phenyl}methyl 4-nitrophenyl carbonate (LP13-3)

(LP13-3)

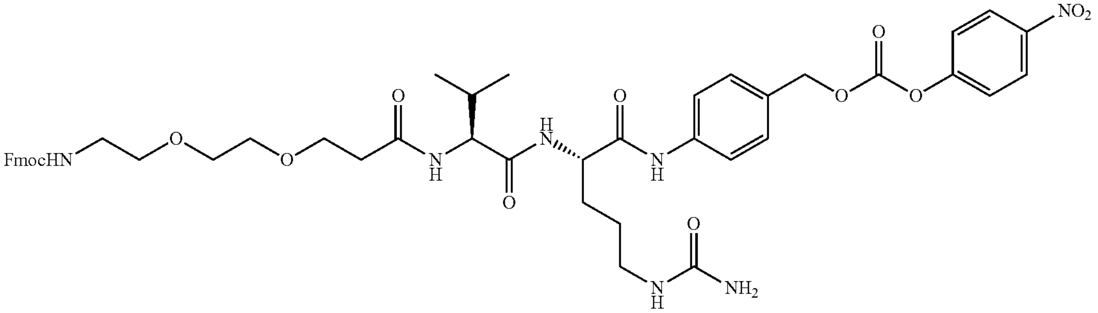

Following the general procedure starting from LP13-2 (0.50 g, 0.66 mmol), linker LP13-3 (0.40 g, 68% yield) was obtained as light yellow oil, which was solidified in air. ESI m/z: 926.5 $(M+H)^+$, 948.4 $(M+Na)^+$.

Example 3U: Methyl (4R)-4-{[(1S)-1-{[(1S)-4-(carbamoylamino)-1-{[4-({[(4-nitrophenoxy) carbonyl]oxy}methyl)phenyl]carbamoyl}butyl]carbamoyl}-2-methylpropyl]carbamoyl}-4-(3-{2-[2-({[(9H-fluoren-9-yl)methoxy]carbonyl}amino)ethoxy]ethoxy}propanamido)butanoate (LP14-3)

(LP14-3)

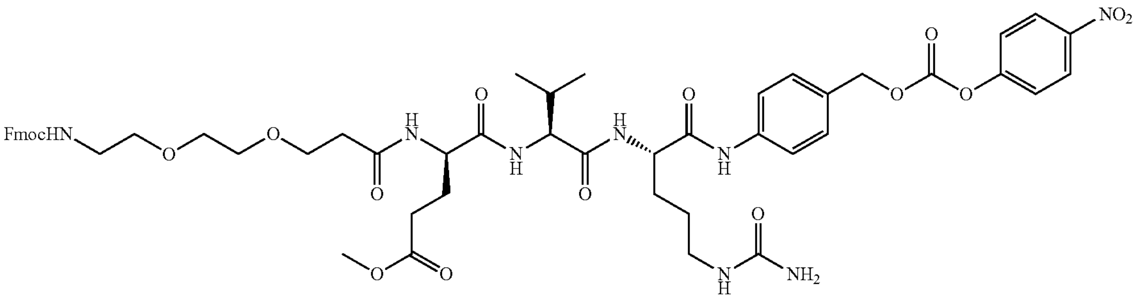

Following the general procedure starting from LP14-2 (0.20 g, 0.22 mmol), linker LP14-3 (0.18 g, 77% yield) was obtained as a white solid. ESI m/z: 1069.2 $(M+H)^+$.

Example 3V: Methyl (4S)-4-{[(1S)-1-{[(1S)-4-(carbamoylamino)-1-{[4-({[(4-nitrophenoxy) carbonyl]oxy}methyl)phenyl]carbamoyl}butyl]carbamoyl}-2-methylpropyl]carbamoyl}-4-(3-{2-[2-({[(9H-fluoren-9-yl)methoxy]carbonyl}amino)ethoxy]ethoxy}propanamido) butanoate (LP15-3)

(LP15-3)

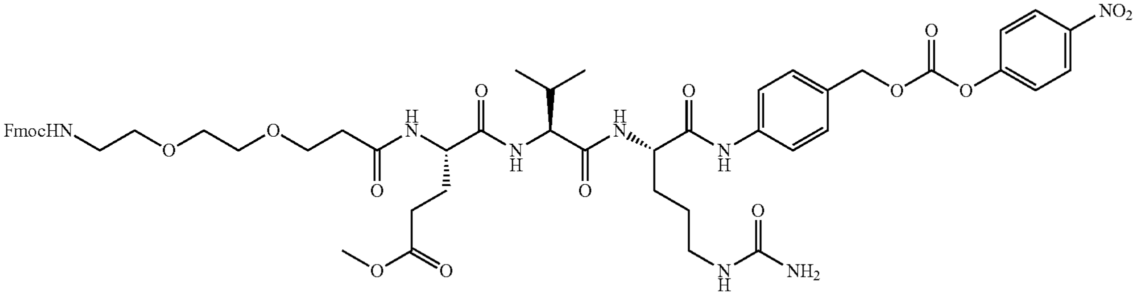

Following the general procedure starting from LP15-2 (0.70 g, 0.77 mmol), linker LP15-3 (0.50 g, 61% yield) was obtained as light yellow oil. ESI m/z: 1069.5 $(M+H)^+$.

Example 3W: {4-[(2S)-5-(Carbamoylamino)-2-[(2S)-2-{1-[2-(cyclooct-2-yn-1-yloxy)acetamido]-3,6,9,12-tetraoxapentadecan-15-amido}-3-methylbutanamido]pentanamido]phenyl}methyl4-nitrophenyl carbonate (LP1-3)

(LP1-3)

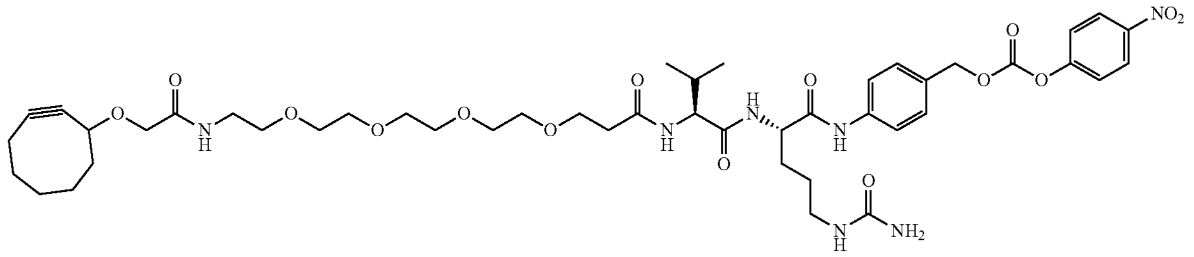

Following the general procedure starting from LP1-2 (2.3 g, 2.9 mmol), linker LP1-3 (1.9 g, 69% yield) was obtained as light yellow oil. ESI m/z: 978.5 $(M+Na)^+$.

Example 3X Methyl (4R)-4-{[(1S)-1-{[(1S)-4-(carbamoylamino)-1-{[4-({[(4-nitrophenoxy) carbonyl] oxy}methyl)phenyl]carbamoyl}butyl]carbamoyl}-2-methylpropyl]carbamoyl}-4-[1-({[(9H-fluoren-9-yl) methoxy]carbonyl}amino)-3,6,9,12-tetraoxapentadecan-15-amido]butanoate (LP19-3)

(LP19-3)

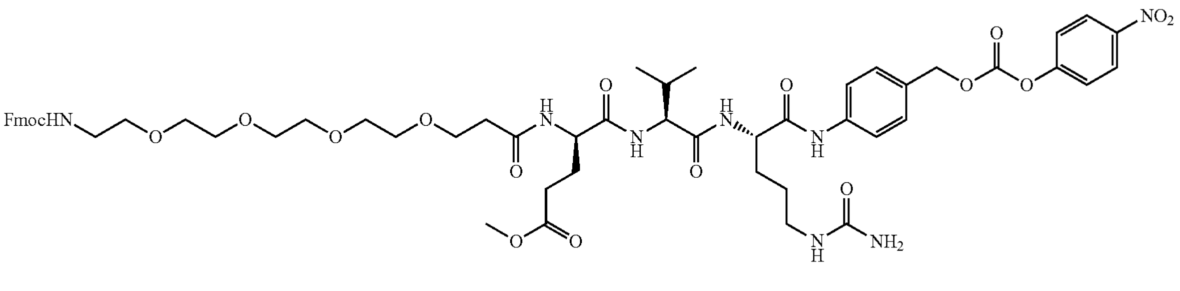

Following the general procedure starting from LP19-2 (0.18 g, 0.18 mmol), linker LP19-3 (0.18 g, 86% yield) was obtained as light yellow oil. ESI m/z: 1157.5 $(M+H)^+$.

Example 3Y: Methyl (4R)-4-{[(1S)-1-{[(1S)-4-(carbamoylamino)-1-{[4-({[(4-nitrophenoxy) carbonyl] oxy}methyl)phenyl]carbamoyl}butyl]carbamoyl}-2-methylpropyl]carbamoyl}-4-{1-[2-(cyclooct-2-yn-1-yloxy)acetamido]-3,6,9,12-tetraoxapentadecan-15-amido}butanoate (LP20-3)

(LP20-3)

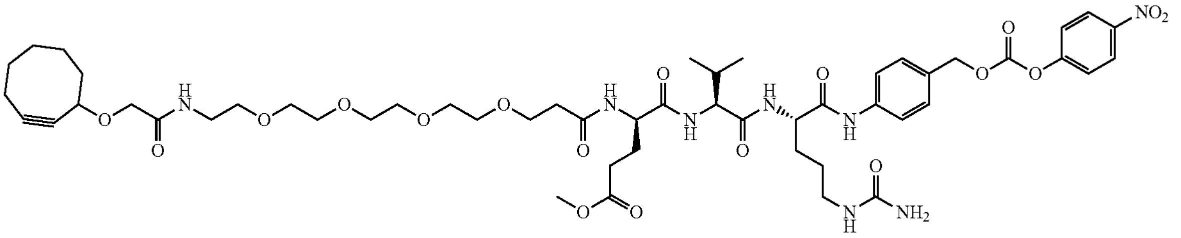

Following the general procedure starting from LP20-2 (0.20 g, 0.21 mmol), linker LP20-3 (0.20 g, 85% yield) was obtained as a yellow solid. ESI m/z: 1099.6 $(M+H)^+$.

Example 3Z: Methyl (4S)-4-{[(1S)-1-{[(1S)-4-(carbamoylamino)-1-{[4-({[(4-nitrophenoxy) carbonyl] oxy}methyl)phenyl]carbamoyl}butyl]carbamoyl}-2-methylpropyl]carbamoyl}-4-[1-({[(9H-fluoren-9-yl) methoxy]carbonyl}amino)-3,6,9,12-tetraoxapentadecan-15-amido]butanoate (LP21-3)

(LP21-3)

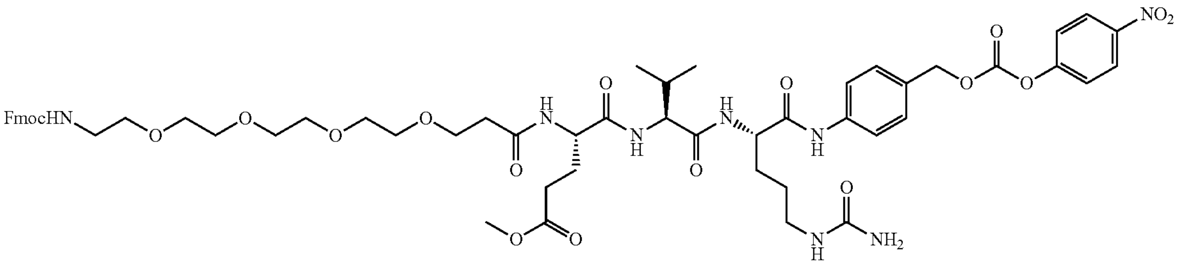

Following the general procedure starting from LP21-2 (0.20 g, 0.20 mmol), linker LP21-3 (0.19 g, 81% yield) was obtained as light yellow oil. ESI m/z: 1157.4 $(M+H)^+$. $^1H$ NMR (400 MHz, $DMSO_{d6}$) δ 10.11 (s, 1H), 8.32 (d, J=8.8 Hz, 2H), 8.17 (d, J=7.2 Hz, 1H), 8.09 (d, J=8.0 Hz, 1H), 7.89 (d, J=7.6 Hz, 2H), 7.77 (d, J=8.4 Hz, 1H), 7.69 (d, J=7.2 Hz, 2H), 7.65 (d, J=8.4 Hz, 2H), 7.57 (d, J=9.2 Hz, 2H), 7.44-7.40 (m, 4H), 7.35-7.31 (m, 3H), 5.99 (br s, 1H), 5.42 (br s, 1H), 5.25 (s, 2H), 4.42-4.36 (m, 2H), 4.29 (d, J=6.8 Hz, 2H), 4.23-4.17 (m, 2H), 3.61-3.57 (m, 6H), 3.50-3.46 (m, 12H), 3.41 (t, J=6.0 Hz, 2H), 3.16-3.11 (m, 2H), 3.12-3.00 (m, 1H), 3.00-2.89 (m, 1H), 2.40-2.30 (m, 4H), 2.01-1.88 (m, 2H), 1.80-1.56 (m, 3H), 1.50-1.33 (m, 2H), 0.87 (d, J=6.8 Hz, 3H), 0.83 (d, J=6.8 Hz, 3H) ppm.

Example 3AA: Methyl (4S)-4-{[(1S)-1-{[(1S)-4-(carbamoylamino)-1-{[4-({[(4-nitrophenoxy) carbonyl]oxy}methyl)phenyl]carbamoyl}butyl]carbamoyl}-2-methylpropyl]carbamoyl}-4-{1-[2-(cyclooct-2-yn-1-yloxy)acetamido]-3,6,9,12-tetraoxapentadecan-15-amido}butanoate (LP22-3)

(LP22-3)

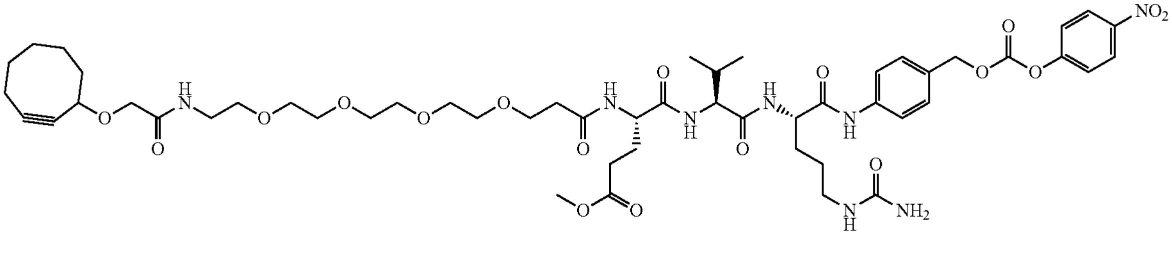

Following the general procedure starting from LP08b-2 (0.10 g, 0.11 mmol), linker LP08b-3 (71 mg, 60% yield) was obtained as a white solid. ESI m/z: 550.5 $(M/2+H)^+$.

Example 3AB: General Procedure for LP1, LP2 and LP #-4

To a solution of LP #-3 (1.0-1.2 equiv.) in DMF (0.15 mM) were added HOBt (0.5 equiv.), DIPEA (3.0 equiv.) and payload P (1.0 equiv.), and the reaction mixture was stirred at room temperature for 2 hours, which was monitored by LCMS. The resulting mixture was directly purified by reversed phase flash chromatography to give LP1, LP2 or LP #-4 as a white solid.

Example 3AC: {4-[(2S)-5-(Carbamoylamino)-2-[(2S)-2-{1-[2-(cyclooct-2-yn-1-yloxy)acetamido]-3,6,9,12-tetraoxapentadecan-15-amido}-3-methylbutanamido]pentanamido]phenyl}methyl N-({[({[(10S,23S)-10-ethyl-18-fluoro-10-hydroxy-19-methyl-5,9-dioxo-8-oxa-4,15-diazahexacyclo [14.7.1.$0^2$, $^{14}.0^4$, $^{13}.0^6$, $^{11}.0^{20}$, $^{24}$]tetracosa-1,6(11),12,14,16,18,20(24)-heptaen-23-yl] carbamoyl}methoxy)methyl]carbamoyl}methyl) carbamate (LP1)

(LP1)

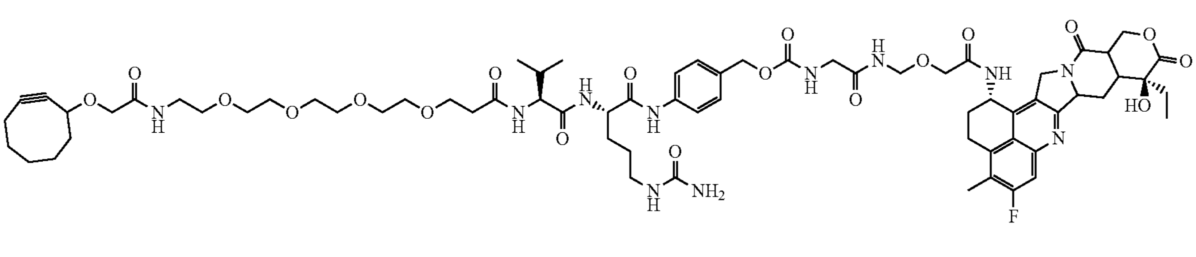

Following the general procedure starting from payload P3 (0.85 g, 1.2 mmol) and LP1-3 (1.2 g, 1.2 mmol), linker-payload LP1 (1.1 g, 62% yield, formic acid salt) was obtained as a white solid after purification by prep-HPLC (5-60% acetonitrile in aq. formic acid (0.1%)). ESI m/z: 699.0 $(M/2+H)^+$. $^1$H NMR (400 MHz, $DMSO_{d6}$) δ 10.00 (s, 1H), 8.80 (t, J=6.4 Hz, 1H), 8.51 (d, J=8.8 Hz, 1H), 8.13 (d, J=7.6 Hz, 1H), 7.90 (d, J=8.8 Hz, 1H), 7.79 (d, J=10.8 Hz, 1H), 7.65-7.50 (m, 3H), 7.43 (t, J=6.0 Hz, 1H), 7.31 (s, 1H), 7.27 (d, J=8.8 Hz, 2H), 6.54 (s, 1H), 5.98 (t, J=5.2 Hz, 1H), 5.63-5.57 (m, 1H), 5.41 (s, 4H), 5.21 (s, 2H), 4.92 (s, 2H), 4.62 (d, J=6.4 Hz, 2H), 4.43-4.33 (m, 1H), 4.31-4.17 (m, 2H), 4.01 (s, 2H), 3.86 (d, J=14.4 Hz, 1H), 3.75 (d, J=14.8 Hz, 1H), 3.67-3.46 (m, 15H), 3.44-3.39 (m, 2H), 3.27-3.10 (m, 4H), 3.06-2.90 (m, 2H), 2.47-2.32 (m, 5H), 2.26-1.64 (m, 14H), 1.63-1.52 (m, 3H), 1.47-1.32 (m, 3H), 0.90-0.80 (m, 9H) ppm. $^{19}$F NMR (376 MHz, $DMSO_{d6}$) δ −111 ppm.

Example 3AD: {4-[(2S)-2-[(2S)-2-[1-(4-{2-Azatricyclo[10.4.0.0$^{4}$, $^{9}$]hexadeca-1(12),4(9),5,7,13,15-hexaen-10-yn-2-yl}-4-oxobutanamido)-3,6,9,12-tetraoxapentadecan-15-amido]-3-methylbutanamido]-5-(carbamoylamino)pentanamido]phenyl}methyl N-({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamate (LP2)

(LP2)

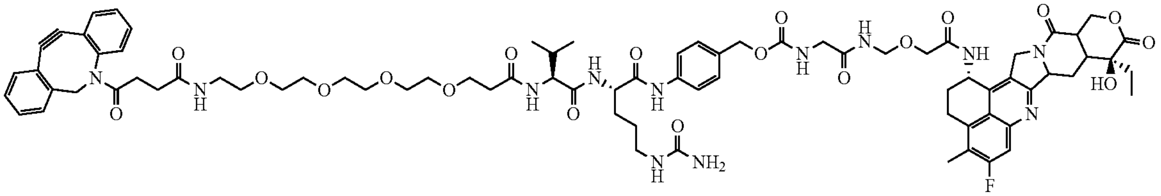

Following the general procedure starting from payload P3 (10 mg, 17 μmol) and LP2-3 (CAS 2226472-28-0, synthesized according to WO2018089373, 18 mg, 17 μmol), linker-payload LP2 (12 mg, 46% yield) was obtained as a white solid after purification by prep-HPLC (5-95% acetonitrile in aq. ammonium bicarbonate (10 mM)). ESI m/z: 513.4 $(M/3+H)^+$, Rt=6.63 min in HPLC (E-ring-opened form, 34%); 507.4 (M/3+H), 760.5 (M/2+H), Rt=7.45 min in HPLC (lactone form, 64%). $^{1}$H NMR (400 MHz, $DMSO_{d6}$) δ 9.99 (s, 1H), 8.80 (t, J=6.4 Hz, 1H), 8.50 (d, J=8.8 Hz, 1H), 8.12 (d, J=7.2 Hz, 1H), 7.87 (d, J=8.4 Hz, 1H), 7.80-7.75 (m. 2H), 7.69-7.67 (m, 1H), 7.63-7.58 (m, 3H), 7.51-7.46 (m, 3H), 7.45-7.33 (m, 3H), 7.32-7.26 (m, 4H), 6.53 (s, 1H), 5.98 (t, J=6.0 Hz, 1H), 5.63-5.57 (m, 1H), 5.42 (s, 4H), 5.21 (s, 2H), 5.03 (d, J=14.0 Hz, 1H), 4.93 (s, 2H), 4.63 (d, J=6.8 Hz, 2H), 4.41-4.35 (m, 1H), 4.25-4.21 (m, 1H), 4.02 (s, 2H), 3.62-3.57 (m, 5H), 3.48-3.45 (m, 12H), 3.31-3.28 (m, 2H), 3.23-3.14 (m, 2H), 3.11-3.07 (m, 2H), 3.05-2.98 (m, 1H), 2.96-2.91 (m, 1H), 2.60-2.55 (m, 1H), 2.46-2.44 (m, 1H), 2.39 (s, 3H), 2.35-2.33 (m, 1H), 2.26-2.15 (m, 3H), 2.03-1.94 (m, 2H), 1.88-1.67 (m, 4H), 1.63-1.57 (m, 1H), 1.46-1.33 (m, 2H), 0.88-0.81 (m, 9H) ppm. $^{19}$F NMR (376 MHz, $DMSO_{d6}$) δ −111 ppm.

Example 3AE: (9H-Fluoren-9-yl)methyl N-{2-[2-(2-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}ethoxy)ethoxy]ethyl}carbamate (LP13-4)

(LP13-4)

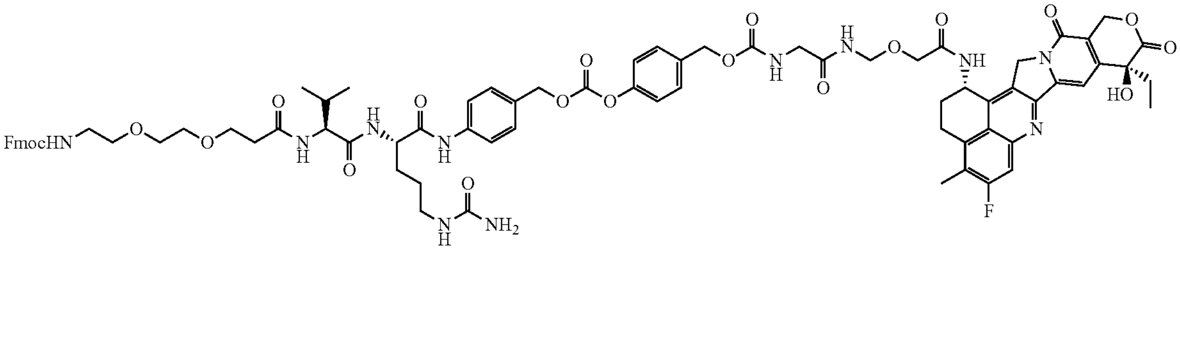

Following the general procedure starting from LP13-3 (0.10 g, 0.11 mmol) and payload P3 (77 mg, 0.11 mmol), compound LP13-4 (0.12 g, 78% yield) was obtained as light yellow oil after purification by reversed phase flash chromatography (0-100% acetonitrile in water in 10 minutes and then 100% acetonitrile for 5 minutes). ESI m/z: 684.0 $(M/2+H)^+$.

Example 3AF: Methyl (4R)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, 11.020,24]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-(3-{2-[2-({[(9H-fluoren-9-yl)methoxy]carbonyl}amino)ethoxy]ethoxy}propanamido)butanoate (LP14-4)

(LP14-4)

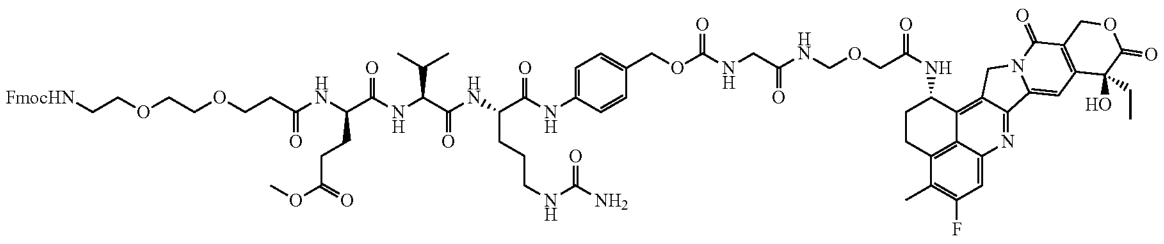

Following the general procedure starting from LP14-3 (0.12 g, 0.11 mmol) and payload P3 (64 mg, 0.11 mmol), compound LP14-4 (0.13 g, 78% yield) was obtained as a white solid after purification by reversed phase flash chromatography (0-60% acetonitrile in aq. ammonium bicarbonate (10 mM)). ESI m/z: 755.7 $(M/2+H)^+$.

Example 3AG: Methyl (4S)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-(3-{2-[2-({[(9H-fluoren-9-yl)methoxy]carbonyl}amino) ethoxy]ethoxy}propanamido)butanoate (LP15-4)

(LP15-4)

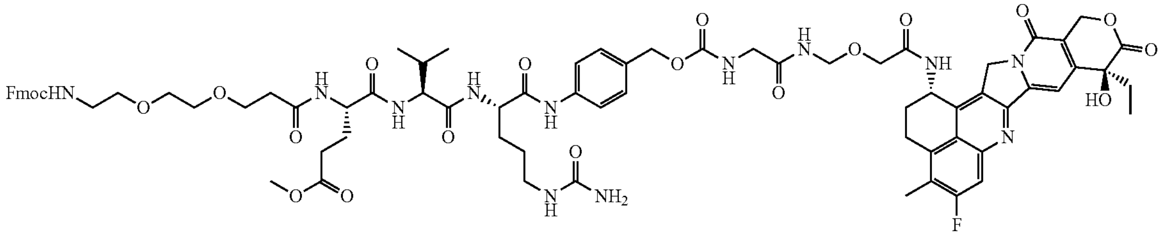

Following the general procedure starting from LP15-3 (0.50 g, 0.47 mmol) and P3 (0.22 g, 0.38 mmol), compound LP15-4 (0.40 g, 56% yield) was obtained as a white solid. ESI m/z: 755.5 $(M/2+H)^+$.

Example 3AH: Methyl (4R)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-[1-({[(9H-fluoren-9-yl)methoxy]carbonyl}amino)-3,6,9,12-tetraoxapentadecan-15-amido]butanoate (LP19-4)

(LP19-4)

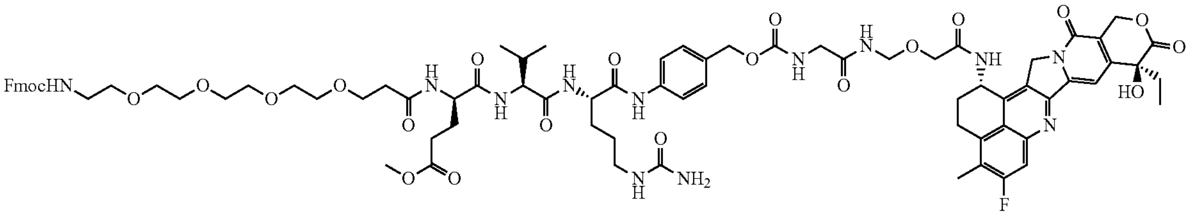

Following the general procedure starting from LP19-3 (80 mg, 69 μmol) and payload P3 (40 mg, 69 μmol), compound LP19-4 (70 mg, 64% yield) was obtained as a white solid. ESI m/z: 799.5 $(M/2+H)^+$.

Example 3AI: Methyl (4R)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-{1-[2-(cyclooct-2-yn-1-yloxy)acetamido]-3,6,9,12-tetraoxapentadecan-15-amido}butanoate (LP20-4)

(LP20-4)

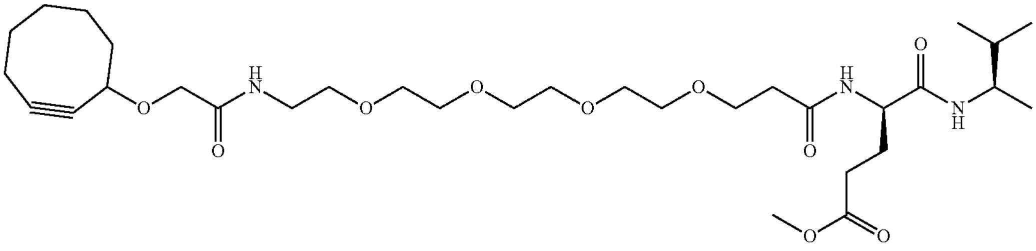

-continued

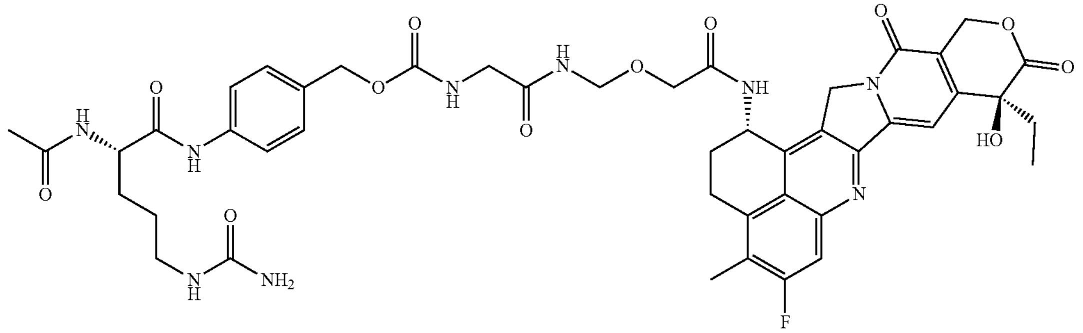

Following the general procedure starting from LP20-3 (95 mg, 86 μmol) and payload P3 (58 mg, 0.10 mmol), compound LP20-4 (60 mg, 45% yield) was obtained as a light yellow solid. ESI m/z: 770.6 $(M/2+H)^+$.

Example 3AJ: Methyl (4S)-4-{[(1S)-1-{[(1S)-4-(carbamoylamino)-1-{[4-({[({[({[(0S,23S)-10-ethyl-18-fluoro-10-hydroxy-19-methyl-5,9-dioxo-8-oxa-4,15-diazahexacyclo[14.7.1.$0^2$, $^{14}.0^4$, $^{13}.0^6$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-[1-({[(9H-fluoren-9-yl)methoxy]carbonyl}amino)-3,6,9,12-tetraoxapentadecan-15-amido]butanoate (LP21-4)

(LP21-4)

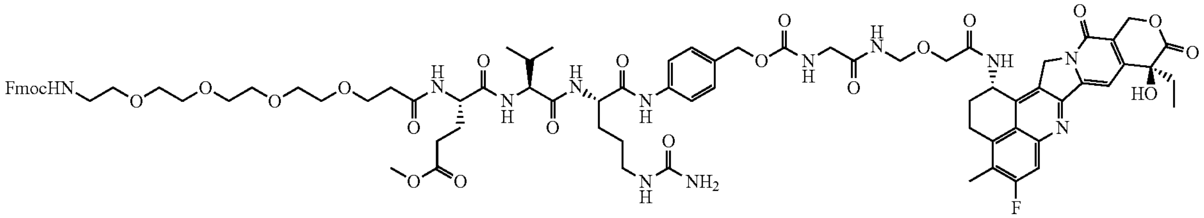

Following the general procedure starting from LP21-3 (58 mg, 50 μmol) and payload P3 (35 mg, 50 μmol), compound LP21-4 (51 mg, 64% yield) was obtained as a white solid. ESI m/z: 799.8 $(M/2+H)^+$. $^1H$ NMR (400 MHz, $DMSO_{d6}$) δ 10.04 (s, 1H), 8.80 (t, J=6.4 Hz, 1H), 8.51 (d, J=8.4 Hz, 1H), 8.16 (d, J=7.6 Hz, 1H), 8.09 (d, J=7.6 Hz, 1H), 7.88 (d, J=7.6 Hz, 2H), 7.78 (d, J=10.8 Hz, 2H), 7.69 (d, J=7.2 Hz, 2H), 7.58 (d, J=8.8 Hz, 2H), 7.44-7.39 (m, 3H), 7.34-7.31 (m, 4H), 7.27 (d, J=8.4 Hz, 2H), 6.53 (br s, 1H), 5.99 (br s, 1H), 5.62-5.57 (m. 1H), 5.42 (s, 2H), 5.46-5.37 (m. 1H), 5.20 (s, 2H), 4.93 (s, 2H), 4.63 (d, J=5.6 Hz, 2H), 4.41-4.33 (m, 2H), 4.30-4.28 (m, 2H), 4.22-4.16 (m, 2H), 4.02 (s, 2H), 3.63-3.57 (m, 8H), 3.50-3.46 (m, 12H), 3.40 (t, J=6.0 Hz, 2H), 3.26-3.18 (m, 1H), 3.15-3.10 (m, 3H), 3.07-2.99 (m, 1H), 2.99-2.90 (m, 1H), 2.42-2.30 (m, 7H), 2.21-2.14 (m, 2H), 1.97-1.82 (m, 4H), 1.77-1.59 (m, 3H), 1.54-1.32 (m, 2H), 0.88-0.82 (m, 9H) ppm.

Example 3AK: Methyl (4S)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, 24]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-{1-[2-(cyclooct-2-yn-1-yloxy)acetamido]-3,6,9,12-tetraoxapentadecan-15-amido}butanoate (LP22-4)

(LP22-4)

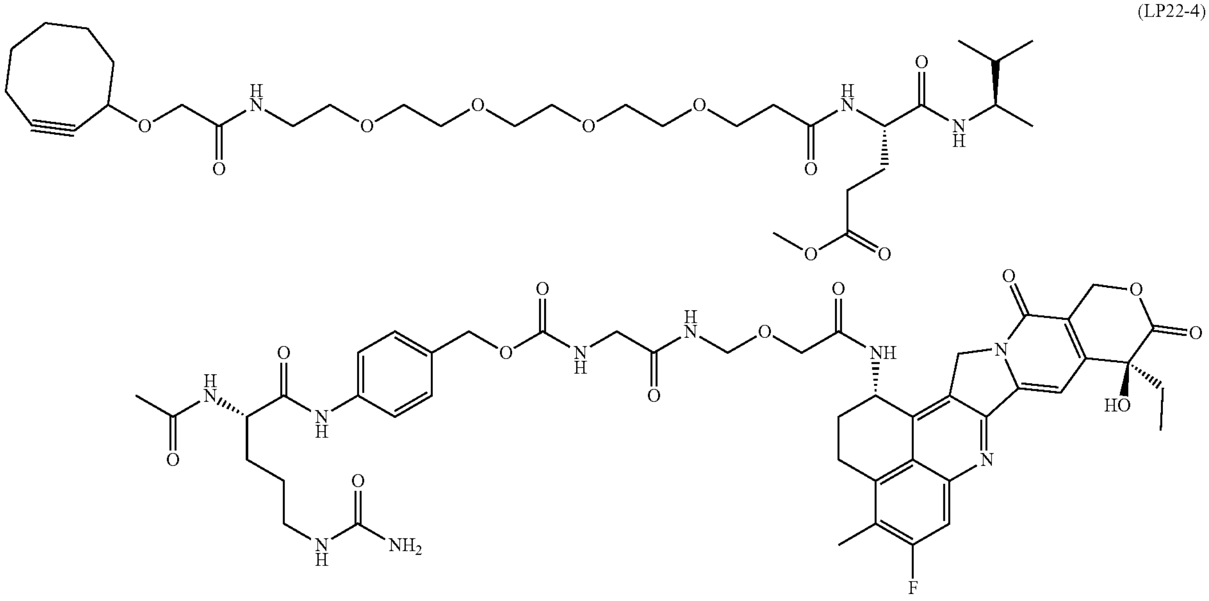

Following the general procedure starting from LP22-3 (80 mg, 73 μmol) and payload P3 (43 mg, 73 μmol), compound LP22-4 (60 mg, 60% yield) was obtained as a white solid after purification by reversed phase flash chromatography (0-60% acetonitrile in aq. ammonium bicarbonate (10 mM)). ESI m/z: 770.5 (M/2+H)$^{+}$.

Example 3AL: {4-[(2S)-2-[(2S)-2-{3-[2-(2-Amino-ethoxy)ethoxy]propanamido}-3-methylbutanamido]-5-(carbamoylamino)pentanamido]phenyl}methyl N-({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamate (LP13)

(LP13)

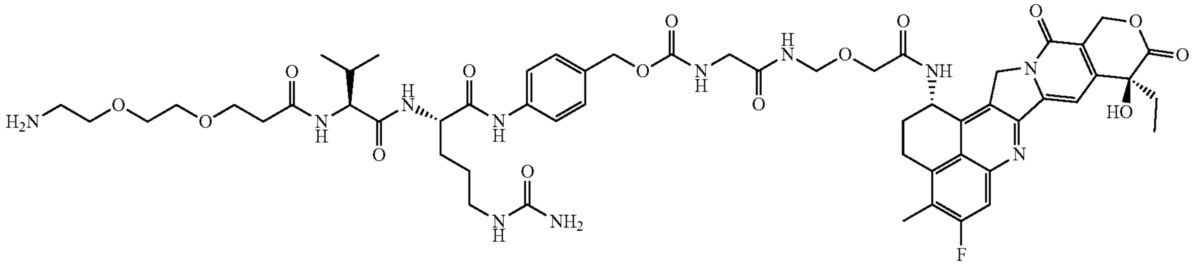

To a solution of LP13-4 (0.12 g, 84 μmol) in anhydrous DMF (1.8 mL) was added diethylamine (0.2 mL), and the mixture was stirred at room temperature for an hour until Fmoc was totally removed according to LCMS. The resulting solution was directly separated by reversed phase flash chromatography (0-100% acetonitrile in aq. TFA (0.01%) in 10 minutes) to give LP13 (50 mg, 52% yield) as a light yellow solid. ESI m/z: 573.0 $(M/2+H)^+$.

Example 3AM: (4R)-4-{3-[2-(2-Aminoethoxy)ethoxy]propanamido}-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.$0^2$, $^{14}.0^4$, $^{13}.0^6$, $^{11}$.$0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}butanoic Acid (LP14)

(LP14)

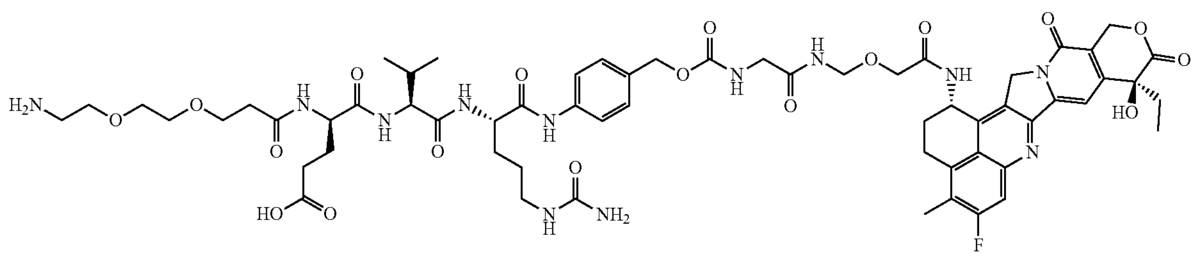

To a solution of compound LP14-4 (0.10 g, 66 μmol) in DMF (3 mL) was added piperidine (56 mg, 0.66 mmol), and the mixture was stirred at room temperature for 2 hours until Fmoc was removed, which was monitored by LCMS. To the reaction mixture were added aq. lithium hydroxide (0.2 mM, 1 mL) and THF (3 mL), and the mixture was stirred at room temperature for another an hour until methyl ester was totally hydrolyzed according to LCMS. After filtered, the resulting mixture was acidified by PBS buffer (pH 3.0) to pH 5.0 and then concentrated in vacuo. The residue was purified by prep-HPLC (10-95% acetonitrile in aq. TFA (0.01%)) to give linker-payload LP14 (40 mg, 47% yield) as a white solid. ESI m/z: 637.5 $(M/2+H)^+$.

Example 3AN: (4S)-4-{3-[2-(2-Aminoethoxy)ethoxy]propanamido}-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.$0^2$, $^{14}.0^4$, $^{13}.0^6$, $^{11}$.020, $^{24}$]tetracosa-1,6(11)12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}butanoic Acid (LP15)

(LP15)

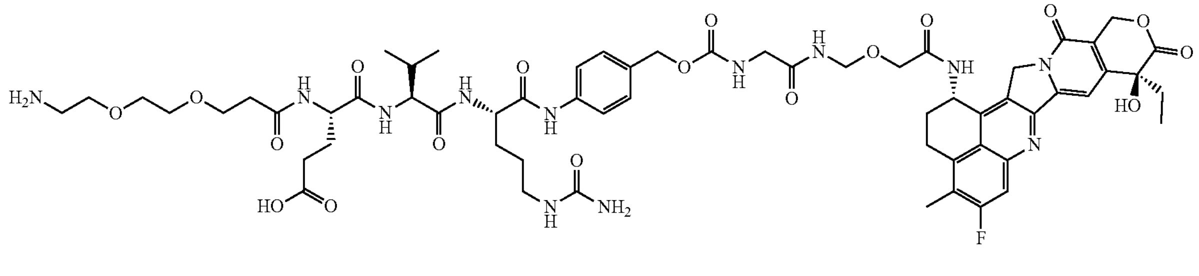

Following the similar procedure as LP14 except substituting LP15-4 for LP14-4, linker-payload LP15 (50 mg, 14% yield) was obtained as a white solid after purification by prep-HPLC (10-95% acetonitrile in aq. TFA (0.05%)). ESI m/z: 637.4 $(M/2+H)^+$.

Example 3AO: (4R)-4-(1-Amino-3,6,9,12-tetraoxapentadecan-15-amido)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2,14}$.0$^{4,13}$.0$^{6,11}$.0$^{20,24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}butanoic Acid (LP19)

(LP19)

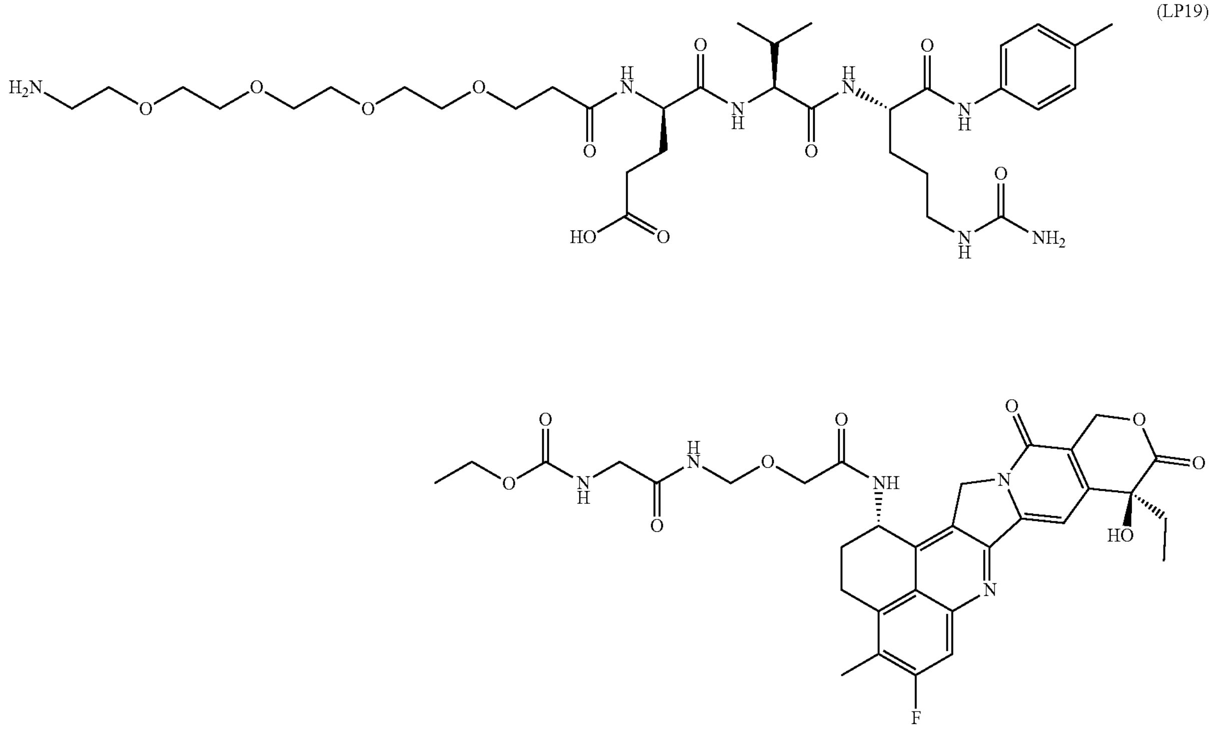

Following the similar procedure as LP14 except substituting LP19-4 (60 mg, 38 μmol) for LP14-4, linker-payload LP19 (12 mg, 24% yield) was obtained as a white solid after purification by prep-HPLC (10-95% acetonitrile in aq. TFA (0.05%)). ESI m/z: 681.5 $(M/2+H)^+$. $^1$H NMR (400 MHz, $DMSO_{d6}$) δ 9.80 (s, 1H), 8.81 (t, J=6.4 Hz, 1H), 8.52 (d, J=8.8 Hz, 1H), 8.19-8.13 (m, 2H), 8.08 (d, J=8.4 Hz, 1H), 7.81-7.75 (m, 3H), 7.61 (d, J=6.4 Hz, 2H), 7.43 (t, J=6.0 Hz, 1H), 7.31 (s, 1H), 7.27 (d, J=8.4 Hz, 2H), 6.55 (br s, 1H), 6.04-5.99 (m, 1H), 5.64-5.57 (m, 1H), 5.43-5.40 (m, 2H), 5.20 (s, 2H), 4.93 (s, 2H), 4.63 (d, J=6.4 Hz, 2H), 4.40-4.32 (m, 2H), 4.23-4.19 (m, 1H), 4.02 (s, 2H), 3.63-3.60 (m, 4H), 3.59-3.57 (m, 4H), 3.56-3.54 (m, 3H), 3.51-3.49 (m, 5H), 3.01-2.95 (m, 4H), 2.44-2.41 (m, 1H), 2.39 (s, 3H), 2.31-2.28 (m, 1H), 2.26-2.21 (m, 3H), 2.20-2.15 (m, 2H), 2.09-2.01 (m, 2H), 1.90-1.82 (m, 4H), 1.78-1.72 (m, 2H), 1.66-1.61 (m, 1H), 1.50-1.41 (m, 2H), 1.40-1.35 (m, 1H), 0.90-0.82 (m, 11H) ppm. (the proton of COOH was not revealed) $^{19}$F NMR (376 MHz, $DMSO_{d6}$) δ −73.70, −111.28 ppm.-

Example 3AP: (4R)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-{1-[2-(cyclooct-2-yn-1-yloxy)acetamido]-3,6,9,12-tetraoxapenta decan-15-amido}butanoic Acid (LP20)

(LP20)

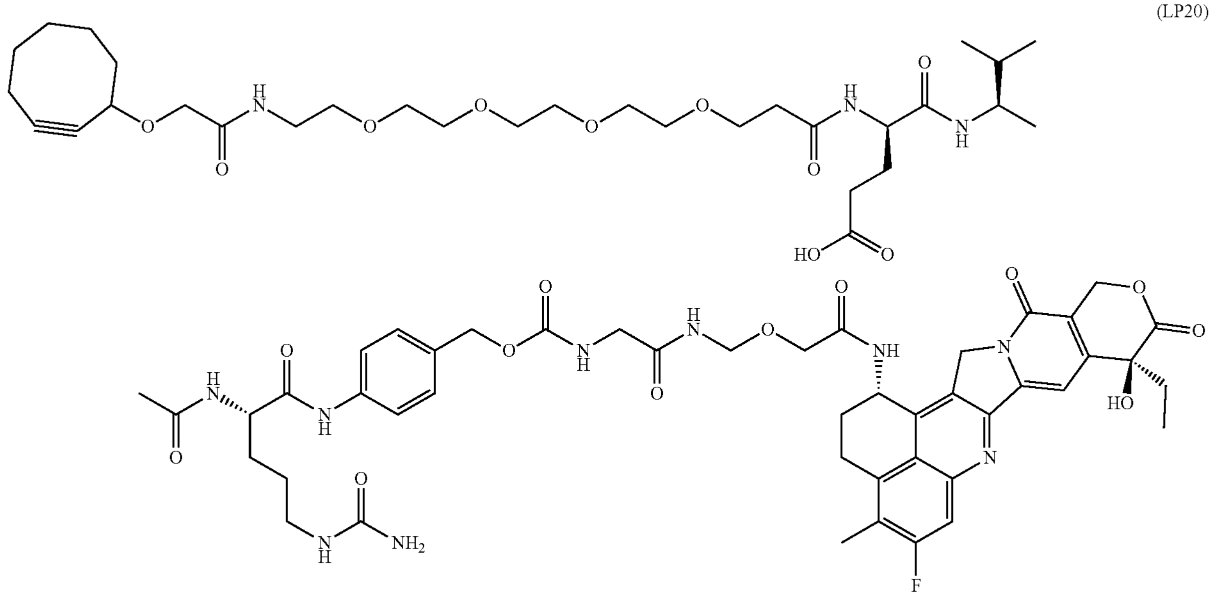

To a solution of compound LP20-4 (60 mg, 39 μmol) in water (1 mL) and THF (3 mL) was added aq. lithium hydroxide (0.12M, 1 mL), and the reaction mixture was stirred at room temperature for 2 hours until methyl ester was totally hydrolyzed, which was monitored by LCMS. The mixture was acidified by PBS buffer (pH 4.0) until pH 6.0, and was then concentrated in vacuo. The residue was purified by prep-HPLC (10-95% acetonitrile in aq. TFA (0.05%)) to give LP20 (15 mg, 25% yield) as a white solid. ESI m/z: 763.5 $(M/2+H)^+$. $^1$H NMR (400 MHz, DMSO$_{d6}$) δ 9.78 (s, 1H), 8.80 (t, J=6.8 Hz, 1H), 8.51 (t, J=8.8 Hz, 1H), 8.18-8.12 (m, 2H), 8.07 (d, J=6.0 Hz, 1H), 7.78 (d, J=11.2 Hz, 1H), 7.63-7.59 (m, 3H), 7.43 (t, J=6.0 Hz, 1H), 7.32-7.22 (m, 4H), 7.11-6.96 (m, 1H), 6.61-6.45 (br s, 1H), 6.02-5.96 (m, 1H), 5.63-5.57 (m, 1H), 5.44-5.38 (m, 3H), 5.20 (s, 2H), 4.92 (s, 2H), 4.63 (d, J=6.0 Hz, 2H), 4.40-4.33 (m, 2H), 4.29-4.25 (m, 1H), 4.24-4.18 (m, 1H), 4.01 (s, 2H), 3.89-3.84 (m, 1H), 3.78-3.73 (m, 1H), 3.63-3.60 (m, 2H), 3.57-3.55 (m, 1H), 3.51-3.47 (m, 8H), 3.27-3.21 (m, 4H), 3.17-3.12 (m, 1H), 3.03-2.99 (m, 1H), 2.97-2.93 (m, 1H), 2.44-2.41 (m, 1H), 2.39 (br s, 3H), 2.28-2.14 (m, 7H), 2.08-1.99 (m, 2H), 1.94-1.81 (m, 6H), 1.80-1.71 (m, 5H), 1.63-1.54 (m, 3H), 1.40-1.33 (m, 4H), 0.90-0.81 (m, 11H) ppm. (The protons of acid and TFA were not revealed.) $^{19}$F NMR (400 MHz, DMSO$_{d6}$) δ −73.86, −111.30 ppm.

Example 3AQ: (4S)-4-(1-Amino-3,6,9,12-tetraoxapentadecan-15-amido)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}butanoic Acid (LP21)

(LP21)

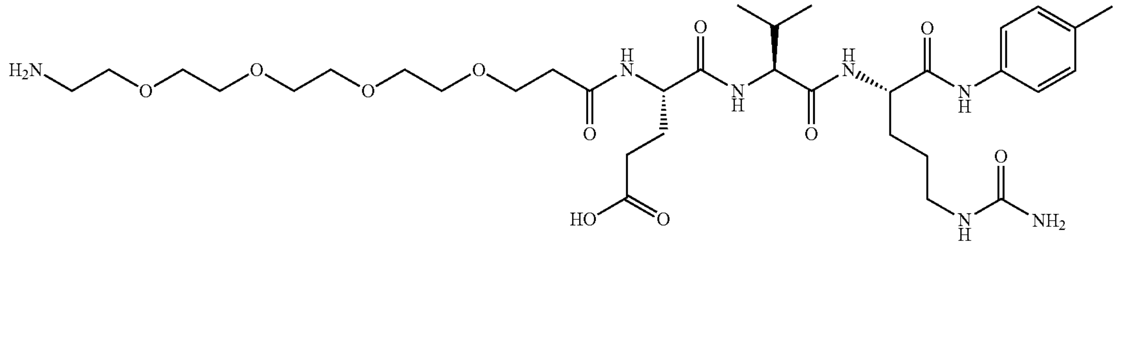

-continued

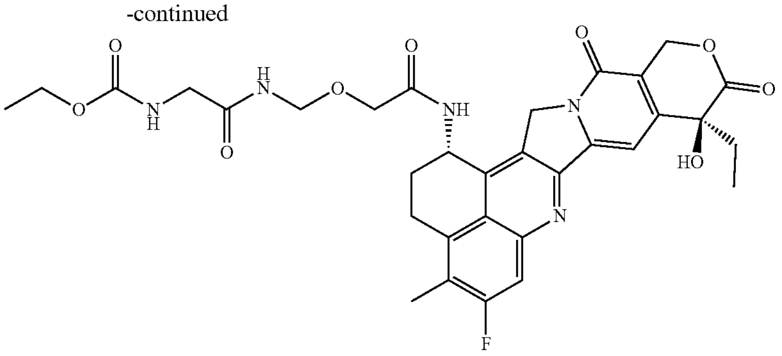

Following the similar procedure as LP14 except substituting LP21-4 (45 mg, 28 μmol) for LP14-4, linker-payload LP21 (10 mg, 26% yield) was obtained as a white solid after purification by prep-HPLC (10-95% acetonitrile in aq. TFA (0.05%)). ESI m/z: 681.4 $(M/2+H)^+$. $^1$H NMR (400 MHz, $DMSO_{d6}$) δ 10.05 (s, 1H), 8.81 (t, J=7.2 Hz, 1H), 8.52 (d, J=8.4 Hz, 1H), 8.19 (d, J=7.6 Hz, 1H), 8.09 (d, J=8.0 Hz, 1H), 7.81-7.68 (m, 5H), 7.58 (d, J=8.4 Hz, 2H), 7.43 (t, J=6.8 Hz, 1H), 7.32 (s, 1H), 7.27 (d, J=8.4 Hz, 2H), 6.54 (brs, 1H), 6.03-5.97 (m, 1H), 5.63-5.57 (m, 1H), 5.48-5.42 (m, 3H), 5.21 (s, 2H), 4.92 (s, 2H), 4.63 (d, J=6.4 Hz, 2H), 4.42-4.31 (m, 2H), 4.22-4.17 (m, 1H), 4.02 (s, 2H), 3.62-3.55 (m, 8H), 3.51-3.48 (m, 12H), 3.20-3.12 (m, 2H), 3.05-2.89 (m, 5H), 2.40 (s, 3H), 2.26-2.21 (m, 2H), 2.20-2.12 (m, 2H), 2.02-1.95 (m, 1H), 1.90-1.80 (m, 3H), 1.74-1.63 (m, 2H), 1.59-1.54 (m, 1H), 1.49-1.31 (m, 2H), 0.88-0.82 (m, 9H) ppm. (The proton of COOH was not revealed) $^{19}$F NMR (376 MHz, $DMSO_{d6}$) δ −73, −111 ppm.

Example 3AR: (4S)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.$0^{2}$, $^{14}.0^{4}$, $^{13}.0^{6}$, $^{11}$. $0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-{1-[2-(cyclooct-2-yn-1-yloxy)acetamido]-3,6,9,12-tetraoxapenta decan-15-amido}butanoic Acid (LP22)

(LP22)

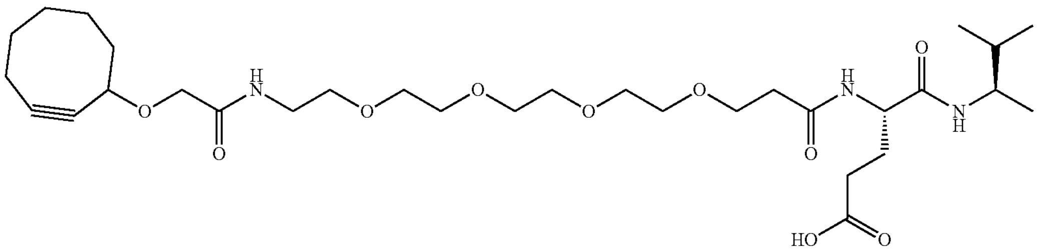

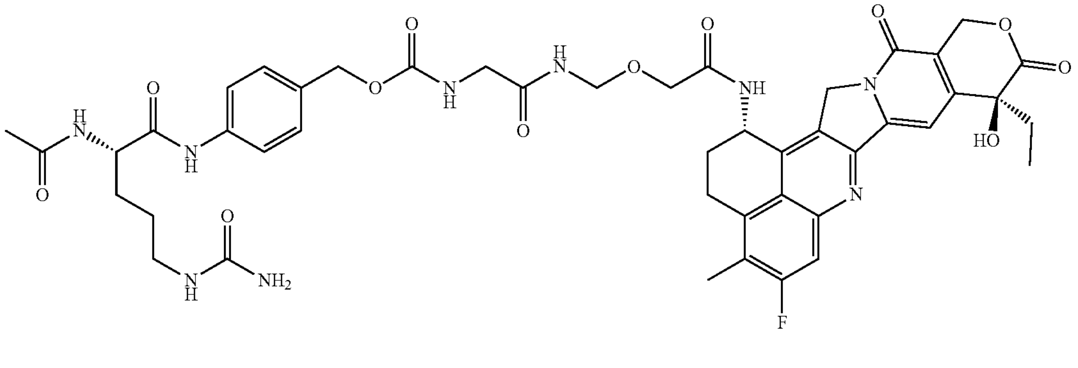

Following the similar procedure as LP20 except substituting LP22-4 (60 mg, 39 μmol) for LP20-4, linker-payload LP22 (15 mg, 26% yield) was obtained as a white solid after purification by prep-HPLC (10-95% acetonitrile in aq. TFA (0.05%)). ESI m/z: 763.5 $(M/2+H)^+$. $^1H$ NMR (400 MHz, $DMSO_{d6}$) δ 9.78 (br s, 1H), 8.80 (t, J=6.8 Hz, 1H), 8.51 (t, J=8.8 Hz, 1H), 8.18-8.12 (m, 2H), 8.07 (d, J=6.0 Hz, 1H), 7.78 (d, J=11.2 Hz, 1H), 7.63-7.59 (m, 3H), 7.43 (t, J=6.0 Hz, 1H), 7.32-7.22 (m, 4H), 7.11-6.96 (m, 1H), 6.61-6.45 (br s, 1H), 6.02-5.96 (m, 1H), 5.63-5.57 (m, 1H), 5.43-5.40 (m, 2H), 5.20 (s, 2H), 4.92 (s, 2H), 4.63 (d, J=6.0 Hz, 2H), 4.40-4.33 (m, 2H), 4.29-4.25 (m, 1H), 4.23-4.18 (m, 1H), 4.01 (s, 2H), 3.89-3.84 (m, 1H), 3.78-3.73 (m, 1H), 3.63-3.60 (m, 2H), 3.57-3.55 (m, 1H), 3.51-3.47 (m, 8H), 3.46-3.45 (m, 2H), 3.27-3.21 (m, 4H), 3.17-3.13 (m, 1H), 3.03-2.99 (m, 1H), 2.97-2.93 (m, 1H), 2.46-2.41 (m, 1H), 2.39 (s, 3H), 2.36-2.31 (m, 1H), 2.27-2.16 (m, 7H), 2.09-2.00 (m, 1H), 2.00-1.81 (m, 7H), 1.80-1.68 (m, 4H), 1.62-1.54 (m, 3H), 1.40-1.35 (m, 3H), 0.90-0.81 (m, 11H) ppm. (proton of COOH was not revealed) $^{19}F$ NMR (376 MHz, $DMSO_{d6}$) δ −73.86, −111.30 ppm.

Example 4: Synthesis of Peptide Linker-Payloads

Linker-payloads LP3, LP4, LP7/LP7', and LP9 were synthesized as described in Scheme 5 and Examples 4A-4F, below.

Starting materials L3-2 (CAS 1353016-71-3) and L4-2 (CAS 1425803-45-7) were commercially obtained from Accela.

Scheme 5: Synthesis of peptide linker-payloads

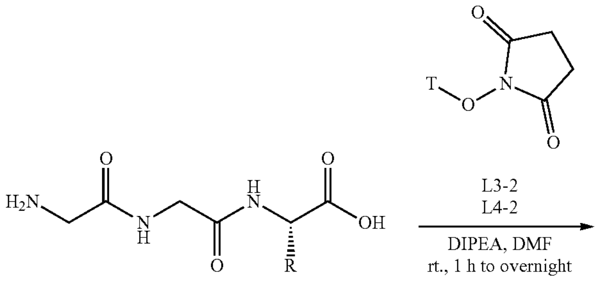

L3-1
L4-1

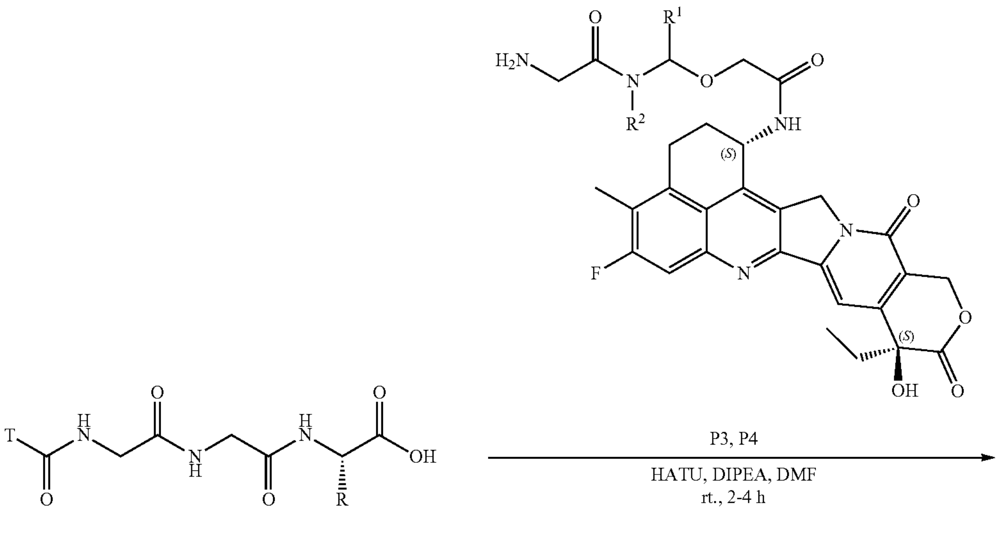

L3-3
L4-3

-continued

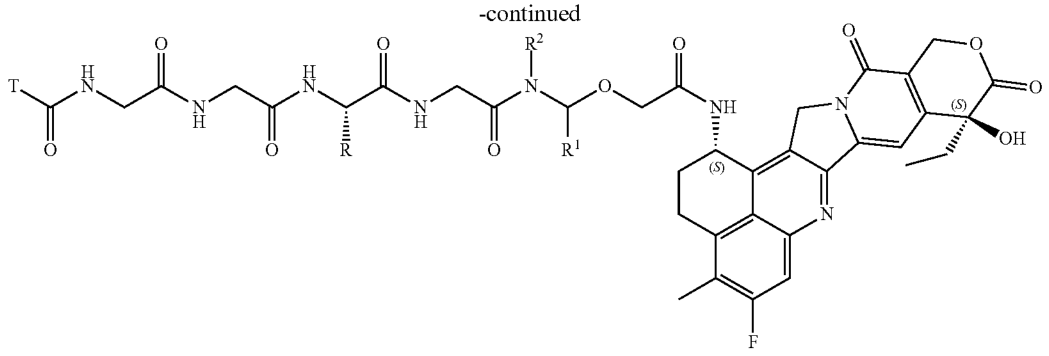

LP3, LP4, LP7, LP7', LP9

LP3, $R^1 = R^2 = R = H$, T = 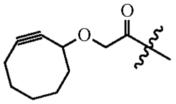

LP4, $R^1 = R^2 = H$, R = Ph, T = 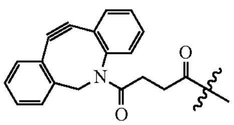

LP7 & LP7', $R^1$, $R^2 = -(CH_2)_3-$, T = 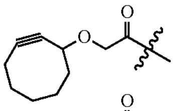

LP9, $R^1 = R^2 = H$, R = Ph, T = 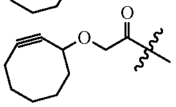

Example 4A: 2-(2-{2-[2-(Cyclooct-2-yn-1-yloxy) acetamido]acetamido}acetamido) acetic Acid (L3-3)

(L3-3)

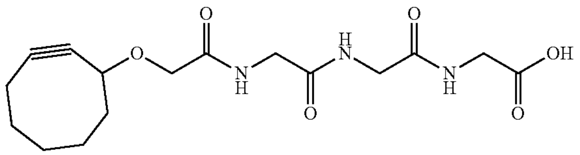

To a suspension of peptide L3-1 (Gly-Gly-Gly-OH, 0.34 g, 1.8 mmol) in DMF (13 mL) were added a solution of L3-2 (0.50 g, 1.8 mmol) in THF (6 mL) and DIPEA (0.69 g, 5.4 mmol), and the turbid mixture was stirred at RT for 20 hours. The mixture was filtered, and the clear filtrate solution was concentrated in vacuo and the residue was purified by reversed phase flash chromatography (0-20% acetonitrile in water) to give compound L3-3 (0.13 g, 21% yield) as a white solid. ESI m/z: 354.2 $(M+H)^+$. $^1H$ NMR (400 MHz, $DMSO_{d6}$) δ 12.6 (s, 1H), 8.20 (t, J=5.6 Hz, 1H), 8.15 (t, J=6.0 Hz, 1H), 7.82 (t, J=5.6 Hz, 1H), 4.35-4.31 (m, 1H), 3.94 (d, J=14.8 Hz, 1H), 3.83-3.73 (m, 7H), 2.29-2.06 (m, 3H), 1.99-1.93 (m, 1H), 1.91-1.71 (m, 3H), 1.63-1.56 (m, 2H), 1.46-1.37 (m, 1H) ppm.

Example 4B: 2-[2-(2-{2-[2-(Cyclooct-2-yn-1-yloxy)acetamido]acetamido}acetamido)acetamido]-N-[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11)12,14,16,18,20(24)-heptaen-23-yl]carbamoyl}methoxy)methyl]acetamide (LP3)

(LP3)

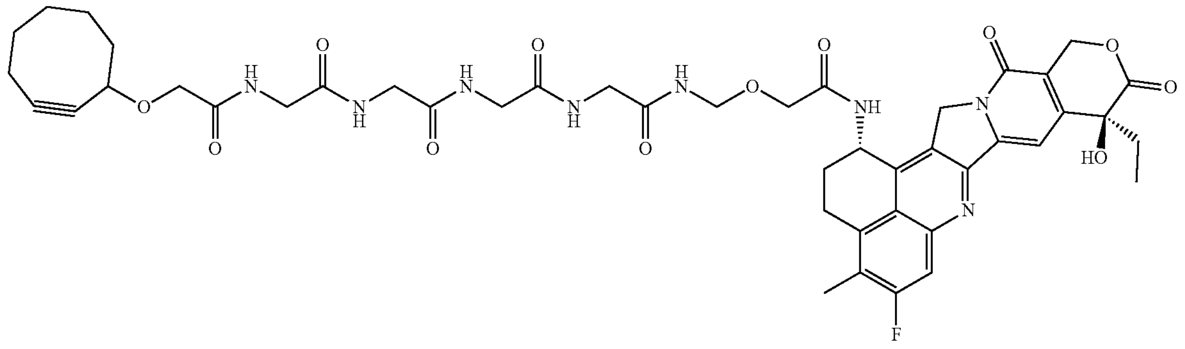

To a yellow solution of compound L3-3 (9.0 mg, 25 μmol) in dry DMF (14 mL) were added DIPEA (9.0 mg, 70 μmol) and HATU (10 mg, 26 μmol), and the mixture was stirred at RT for 30 minutes before the addition of payload P3 (15 mg, 22 μmol). The reaction mixture was stirred at RT for 2 hours until most of starting materials were consumed according to LCMS. The resulting mixture was directly purified by prep-HPLC (0-100% acetonitrile in aq. TFA (0.01%)) to give linker-payload LP3 (8.0 mg, 36% yield, TFA salt) as a light yellow solid. ESI m/z: 915.5 $(M+H)^+$. $^1$H NMR (400 MHz, DMSO$_{d6}$) δ 8.68 (t, J=6.6 Hz, 1H), 8.51 (d, J=8.8 Hz, 1H), 8.25-8.12 (m, 3H), 7.86-7.75 (m, 2H), 7.31 (s, 1H), 6.53 (s, 1H), 5.59 (s, 1H), 5.43 (s, 2H), 5.20 (s, 2H), 4.63 (d, J=6.5 Hz, 2H), 4.31 (m, 1H), 4.01 (s, 2H), 3.92 (d, J=14.9 Hz, 1H), 3.75 (m, 9H), 3.18 (s, 2H), 2.40 (s, 3H), 2.26-2.02 (m, 5H), 1.96-1.70 (m, 6H), 1.63-1.53 (m, 2H), 1.39 (d, J=8.7 Hz, 1H), 0.87 (t, J=7.3 Hz, 3H) ppm. $^{19}$F NMR (376 MHz, DMSO$_{d6}$) δ −74 (TFA), −111 (Ar—F) ppm.

Example 4C: (2S)-2-{2-[2-(4-{2-Azatricyclo[10.4.0.0$^{4}$, $^{9}$]hexadeca-1(12),4(9),5,7,13,15-hexaen-10-yn-2-yl}-4-oxobutanamido)acetamido]acetamido}-3-phenyl propanoic Acid (L4-3)

(L4-3)

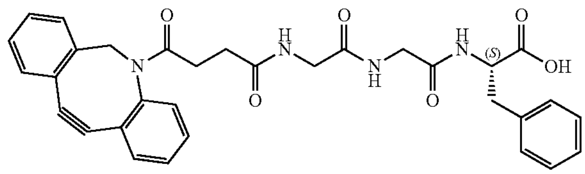

To a solution of compound L4-2 (0.28 g, 0.69 mmol) and peptide L4-1 (Gly-Gly-Phe-OH, 0.19 g, 0.69 mmol) in DMF (10 mL) was added DIPEA (0.37 mL, 2.1 mmol), and the reaction mixture was stirred at RT for an hour. Reaction completion was monitored by LCMS. The resulting mixture was directly purified by reversed phase flash chromatography (0-100% acetonitrile in aq. ammonium bicarbonate (10 mM)) to give compound L4-3 (0.31 g, 78% yield) as a white solid. ESI m/z: 567.0 $(M+H)^+$.-

Example 4D: 4-{2-Azatricyclo[10.4.0.0$^{4}$, $^{9}$]hexadeca-1(12),4(9),5,7,13,15-hexaen-10-yn-2-yl}-N-{[({[(1S)-1-[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11)12,14,16,18,20(24)-heptaen-23-yl]carbamoyl}methoxy)methyl]carbamoyl}methyl)carbamoyl]-2-phenylethyl]carbamoyl}methyl)carbamoyl]methyl}-4-oxobutanamide (LP4)

(LP4)

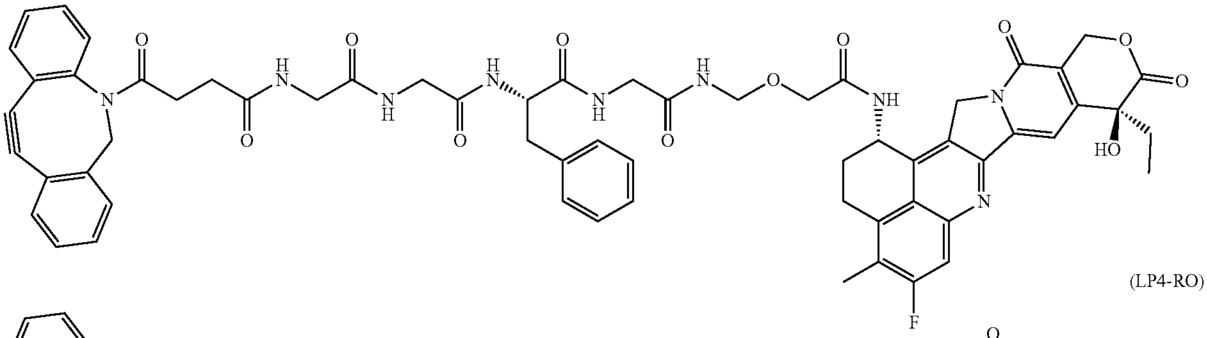

(LP4-RO)

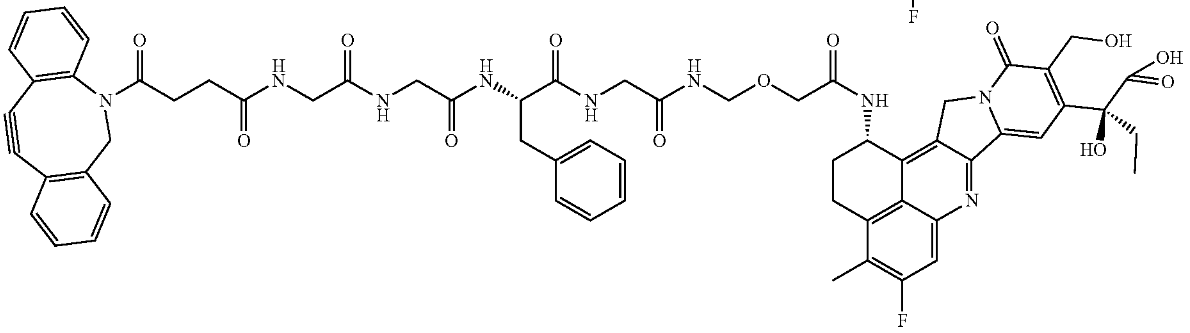

Following the procedure to make LP3 except substituting L4-3 for L3-3, the linker-payload LP4 with and without ring-opening lactone LP4-RO (14 mg, 56% yield) was obtained as a white solid after purification by prep-HPLC (0-100% acetonitrile in aq. ammonium bicarbonate (10 mM)).

Lactone: HPLC purity: 75%, retention time: 7.93 min, ESI m/z: 1128.3 $(M+H)^+$, 564.8 $(M/2+H)^+$; Ring-opening product: HPLC purity: 20%, retention time: 6.94 min, ESI m/z: 1169.4 $(M+Na)^+$, 1146.3 $(M+H)^+$. $^1$H NMR (400 MHz, DMSO$_{d6}$) δ 8.62 (s, 1H), 8.50 (d, J=8.8 Hz, 1H), 8.28 (s, 1H), 8.18-7.91 (m, 3H), 7.78 (d, J=11.5 Hz, 1H), 7.70-7.58 (m, 2H), 7.50-7.38 (m, 3H), 7.29 (m, 3H), 7.24-7.11 (m, 5H), 6.51 (s, 1H), 5.58 (s, 1H), 5.41 (s, 1H), 5.19 (s, 1H), 4.99 (d, J=13.8 Hz, 1H), 4.62 (d, J=6.1 Hz, 2H), 4.46 (s, 1H), 4.01 (s, 2H), 3.70 (m, 3H), 3.56 (m, 3H), 3.22-3.06 (m, 2H), 2.99 (m, 2H), 2.75 (m, 1H), 2.67 (m, 1H), 2.38 (m, 3H), 2.33 (m, 4H), 2.17 (m, 2H), 2.07 (m, 2H), 1.95-1.70 (m, 2H), 0.86 (t, J=7.2 Hz, 3H) ppm.

Example 4E: 2-(Cyclooct-2-yn-1-yloxy)-N-{[({[({2-[2-({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)pyrrolidin-1-yl]-2-oxoethyl}carbamoyl)methyl]carbamoyl}methyl)carbamoyl]methyl}acetamide (diastereoisomer 1, LP7 and diastereoisomer 2, LP7')

(LP7/LP7')

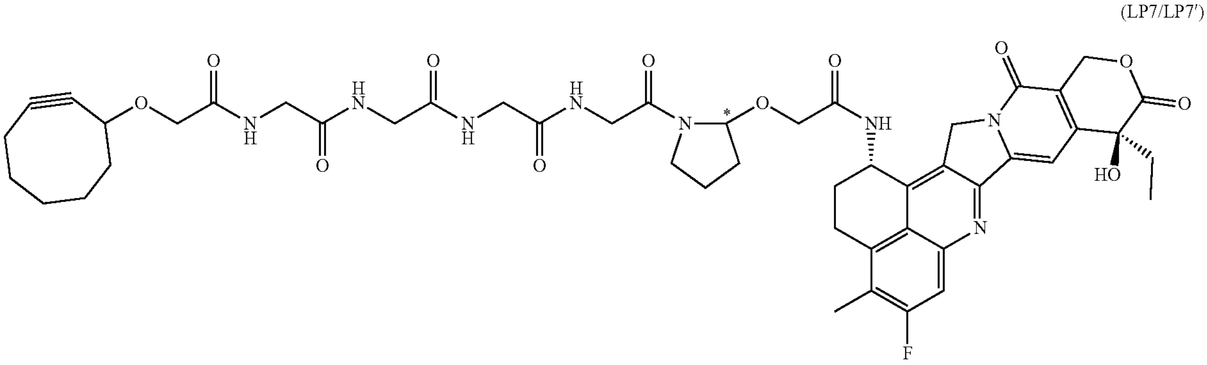 [SMILES: CC[C@@]1(O)C(=O)OCc2c1cc1n(c2=O)Cc2c-1nc1cc(F)c(C)c3c1c2[C@@H](NC(=O)COC1CCCN1C(=O)CNC(=O)CNC(=O)CNC(=O)CNC(=O)COC1C#CCCCCC1)CC3]

Following the procedure as LP3 except substituting P4 for P3, the diastereoisomers LP7 (with and without ring-opening lactone product, 3.0 mg, 7% yield) and LP7' (with and without ring-opening lactone product, 4.0 mg, 9.3% yield) were separately obtained as white solids after purification by prep-HPLC (0-100% acetonitrile in aq. ammonium bicarbonate (8 mM) with ammonia (0.05% v)).

LP7: Lactone: HPLC purity: 11%, retention time: 6.87 min, ESI m/z: 955.3 $(M+H)^+$, Ring-opening product: HPLC purity: 89%, retention time: 5.91 min, ESI m/z: 996.5 $(M+Na)^+$ $^1H$ NMR (400 MHz, $DMSO_{d6}$) δ 8.71-8.57 (m, 1H), 8.30-8.13 (m, 2H), 7.99-7.70 (m, 3H), 7.32-6.67 (m, 2H), 5.63-5.48 (m, 1H), 5.43-5.01 (m, 5H), 4.36-4.27 (m, 1H), 4.21-3.68 (m, 10H), 2.40-2.24 (m, 4H), 2.14-1.33 (m, 22H), 1.14-0.97 (m, 2H), 0.89-0.84 (m, 3H) ppm. $^{19}F$ NMR (376 MHz, $DMSO_{d6}$) δ −111, −112 ppm.

LP7': Lactone: HPLC purity: 21%, retention time: 6.98 min, ESI m/z: 955.3 $(M+H)^+$, Ring-opening product: HPLC purity: 79%, retention time: 6.02 min, ESI m/z: 996.5 $(M+Na)^+$ $^1H$ NMR (400 MHz, $DMSO_{d6}$) δ 8.60-8.55 (m, 1H), 8.31-7.69 (m, 5H), 7.32-7.21 (m, 1H), 6.66-6.53 (m, 1H), 5.64-5.56 (m, 1H), 5.43-5.09 (m, 5H), 4.32-4.30 (m, 1H), 4.16-4.02 (m, 2H), 3.98-3.89 (m, 2H), 3.82-3.55 (m, 6H), 2.40-2.31 (m, 4H), 2.22-1.36 (m, 22H), 1.15-0.98 (m, 2H), 0.89-0.84 (m, 3H) ppm. $^{19}F$ NMR (376 MHz, $DMSO_{d6}$) δ −111, −112 ppm.

Example 4F: 2-[2-(2-{2-[2-(Cyclooct-2-yn-1-yloxy) acetamido]acetamido}acetamido)acetamido]-N-[({[(10S,23S)-10-ethyl-18-fluoro-10-hydroxy-19-methyl-5,9-dioxo-8-oxa-4,15-diazahexacyclo [14.7.1.0$^{2}$, $^{14}$.0$^{4}$, $^{13}$.0$^{6}$, $^{11}$.0$^{20}$, $^{24}$]tetracosa-1,6(11) 12,14,16,18,20(24)-heptaen-23-yl] carbamoyl}methoxy)methyl]acetamide (LP9)

To a yellow solution of compound L3-3 (Example 4A) (9.0 mg, 25 μmol) in dry DMF (14 mL) were added DIPEA (9.0 mg, 70 μmol) and HATU (10 mg, 26 μmol), and the mixture was stirred at room temperature for 30 minutes before the addition of payload P (15 mg, 22 μmol). The reaction mixture was stirred at room temperature for 2 hours until most of starting materials were consumed according to LCMS. The resulting mixture was directly purified by prep-HPLC (0-100% acetonitrile in aq. TFA (0.01%)) to give linker-payload LP9 (8.0 mg, 36% yield, TFA salt) as a light yellow solid. ESI m/z: 915.5 $(M+H)^+$. $^1H$ NMR (400 MHz, $DMSO_{d6}$) δ 8.68 (t, J=6.6 Hz, 1H), 8.51 (d, J=8.8 Hz, 1H), 8.25-8.12 (m, 3H), 7.86-7.75 (m, 2H), 7.31 (s, 1H), 6.53 (s, 1H), 5.59 (s, 1H), 5.43 (s, 2H), 5.20 (s, 2H), 4.63 (d, J=6.5 Hz, 2H), 4.31 (m, 1H), 4.01 (s, 2H), 3.92 (d, J=14.9 Hz, 1H), 3.75 (m, 9H), 3.18 (s, 2H), 2.40 (s, 3H), 2.26-2.02 (m, 5H), 1.96-1.70 (m, 6H), 1.63-1.53 (m, 2H), 1.39 (d, J=8.7 Hz, 1H), 0.87 (t, J=7.3 Hz, 3H) ppm. $^{19}F$ NMR (376 MHz, $DMSO_{d6}$) δ −74 (TFA), −111 (Ar—F) ppm.

Example 5: Synthesis of Acid-Sensitive Linker-Payloads

Linker-payload LP8 was synthesized as described in Scheme 6 and as further described below.

Starting material L2-1 (CAS 1427004-19-0) was commercially obtained from Accela.

(LP9)

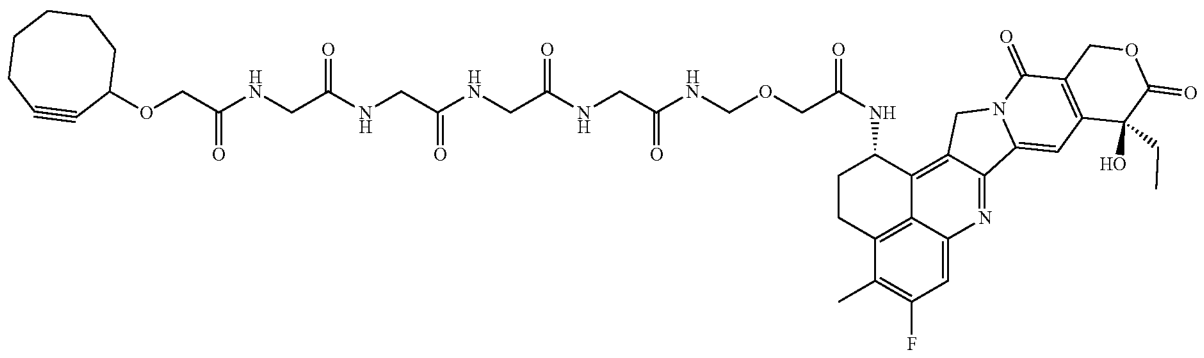

Scheme 6: Synthesis of acid-sensitive linker-payloads

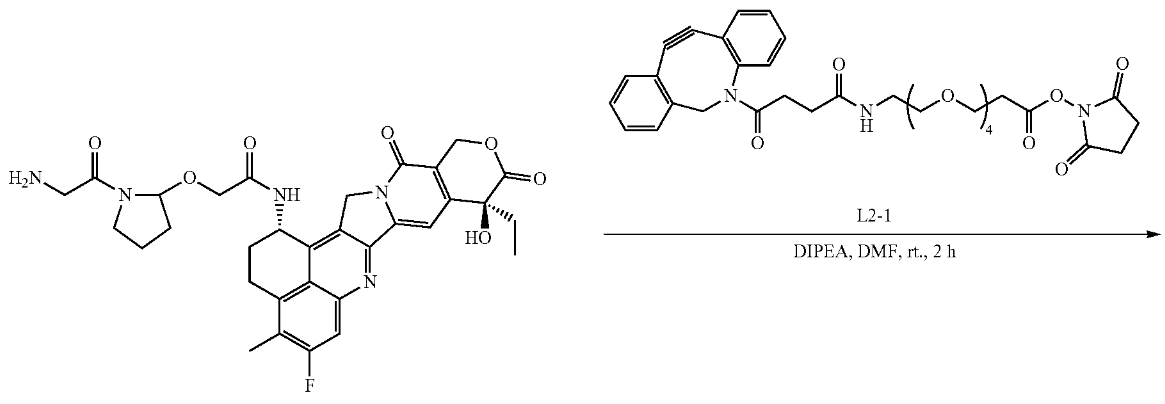

P4

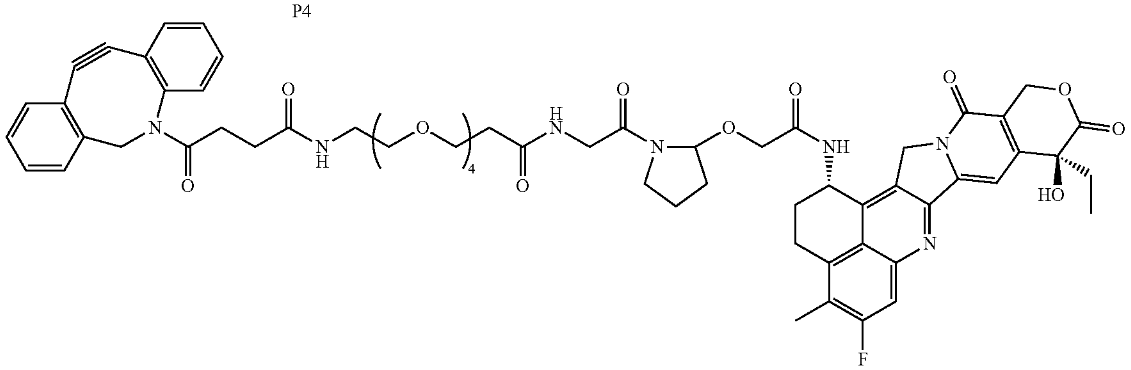

LP8

1-(4-{2-Azatricyclo[10.4.0.0[4], [9]]hexadeca-1(12),4(9),5,7,13,15-hexaen-10-yn-2-yl}-4-oxobutanamido)-N-{2-[2-({[(10S,23S)-10-ethyl-18-fluoro-10-hydroxy-19-methyl-5,9-dioxo-8-oxa-4,15-diazahexacyclo[14.7.1.0[2], [14].0[4], [13].0[6], [11].0[20], [24]]tetracosa-1,6(11)12,14,16,18,20(24)-heptaen-23-yl]carbamoyl}methoxy)pyrrolidin-1-yl]-2-oxoethyl}-3,6,9,12-tetraoxapentadecan-15-amide (LP8)

(LP8)

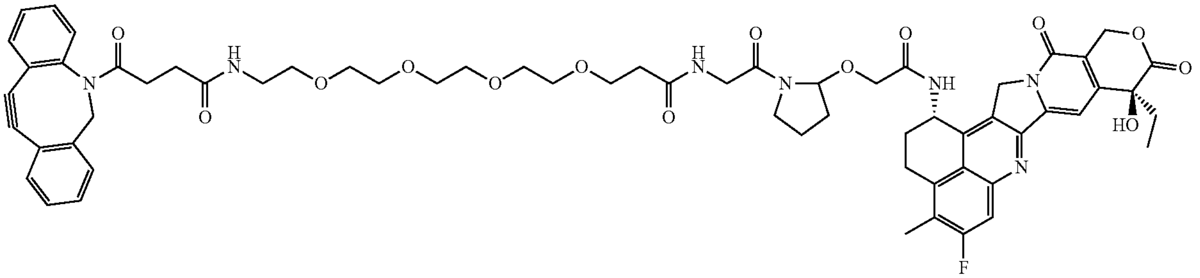

To a solution of payload P4 (6.2 mg, 10 μmol) in DMF (1.0 mL) were added compound L2-1 (6.5 mg, 10 μmol) and DIPEA (3.9 mg, 30 μmol), and the reaction mixture was stirred at RT for 2 hours. Reaction completion was monitored by LCMS. The resulting mixture was directly purified by prep-HPLC (5-95% acetonitrile in aq. ammonium bicarbonate (10 mM)) to give linker-payload LP8 (with lactone ring-opening product, 3.0 mg, 26% yield) as a yellow solid.

Lactone: HPLC purity: 80%, retention time: 8.12 min, ESI m/z: 577.6 $(M/2+H)^+$; Ring-opening product: HPLC purity: 20%, retention time: 6.91 min, ESI m/z: 586.7 $(M/2+H)^+$.

$^1H$ NMR (400 MHz, $DMSO_{d6}$) δ 7.74-7.67 (m, 2H), 7.63-7.58 (m, 1H), 7.56-7.52 (m, 1H), 7.44-7.36 (m, 3H), 7.32-7.20 (m, 4H), 6.60-6.44 (m, 1H), 5.56-5.49 (m, 1H), 5.34 (s, 2H), 5.28-5.16 (m, 1H), 5.11-5.06 (m, 1H), 4.98-4.92 (m, 1H), 4.10-3.91 (m, 2H), 3.75-3.74 (m, 1H), 3.55-3.50 (m, 3H), 3.40-3.37 (m, 13H), 3.22-3.16 (m, 5H), 3.02-2.99 (m, 3H), 2.54-2.48 (m, 2H), 2.31 (d, J=2.8 Hz, 2H), 2.22-2.11 (m, 4H), 1.96-1.88 (m, 4H), 1.82-1.72 (m, 2H), 1.67-1.64 (m, 2H), 1.01 (t, J=7.2 Hz, 2H), 0.92 (t, J=7.2 Hz, 2H), 0.82-0.76 (m, 3H) ppm. $^{19}F$ NMR (376 MHz, $DMSO_{d6}$) δ −111 ppm.

Example 6: Synthesis of Glucose Linker-Payloads
Linker-payloads LP5 and LP6 were synthesized as described in Schemes 7A-7B and Examples 6A-6N, below.
Scheme 7A: synthesis of glucose linker-payloads L5 and L6
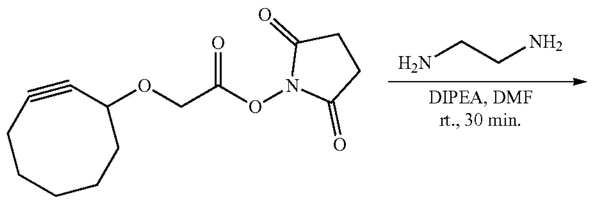
L3-2
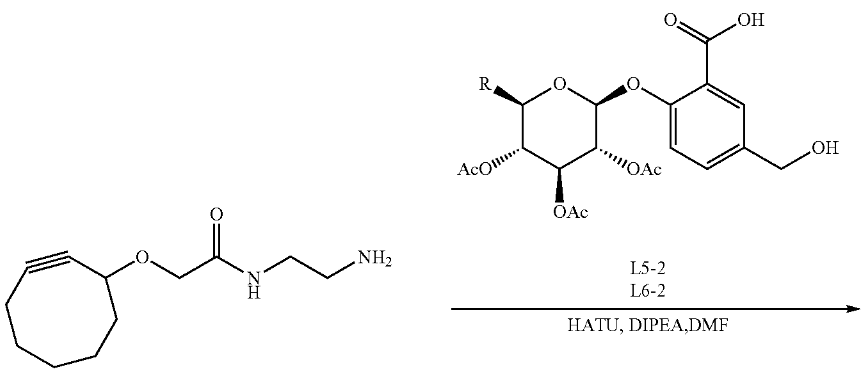
L5-1
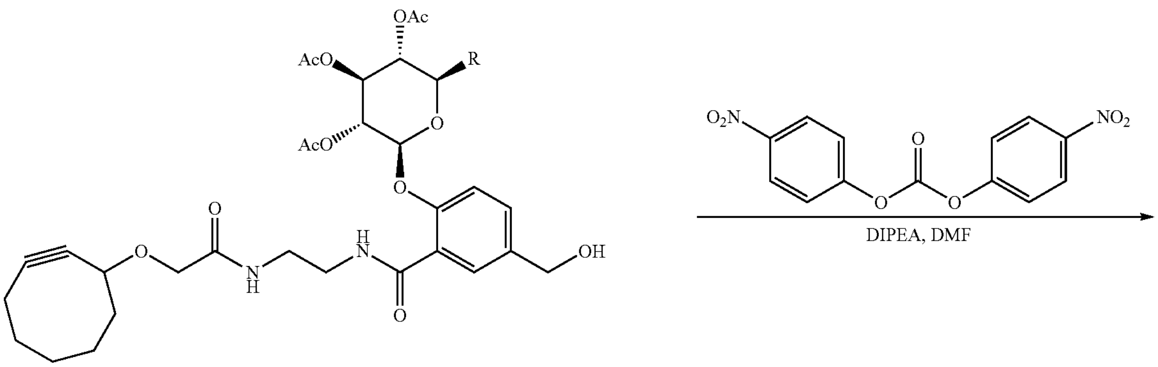
L5-3, R = $CO_2Me$
L6-3, R = $CH_2OAc$ -continued
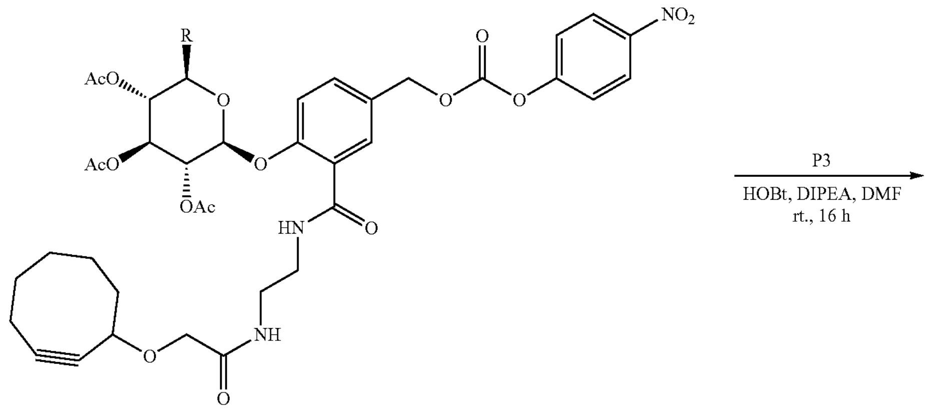
L5-4, R = $CO_2Me$
L6-4, R = $CH_2OAc$
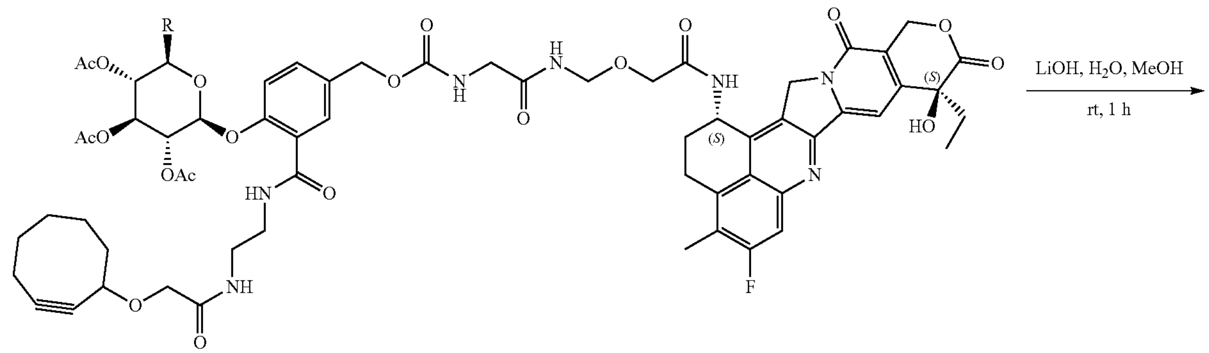
L5-5, R = $CO_2Me$
L6-5, R = $CH_2OAc$
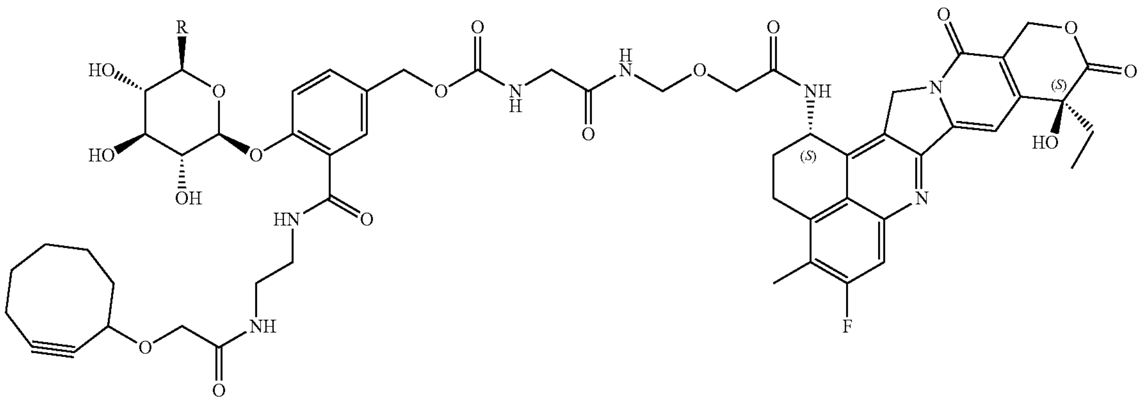
L5, R = $CO_2H$
L6, R = $CH_2OH$ Scheme 7B: synthesis B of glucose linker-payloads L5, L6 and L12
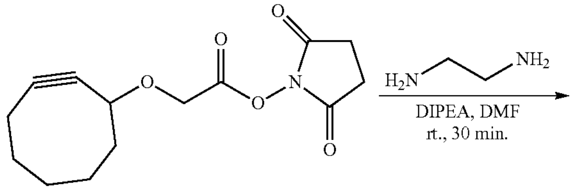
L3-2
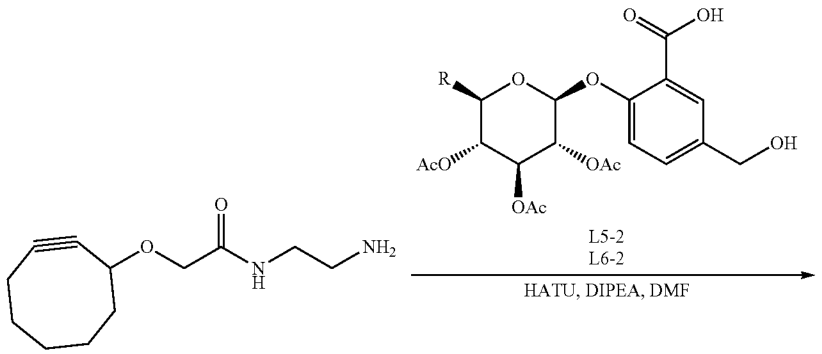
L5-1
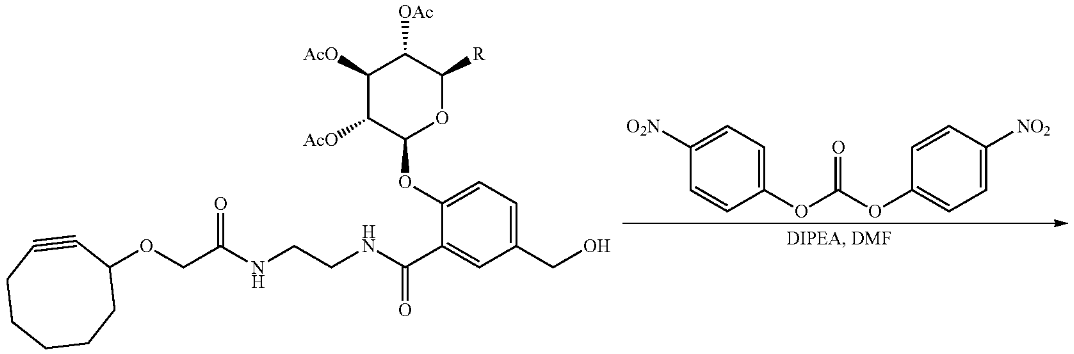
LP5-3, R = $CO_2Me$
LP6-3, R = $CH_2OAc$
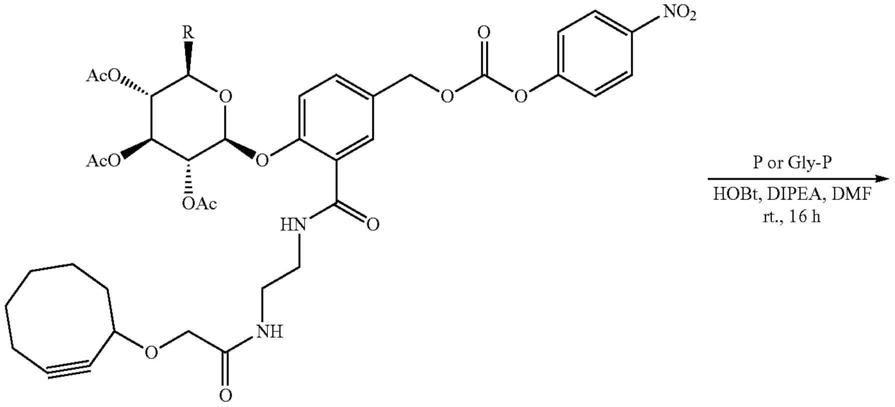
LP5-4, R = $CO_2Me$
LP6-4, R = $CH_2OAc$ -continued
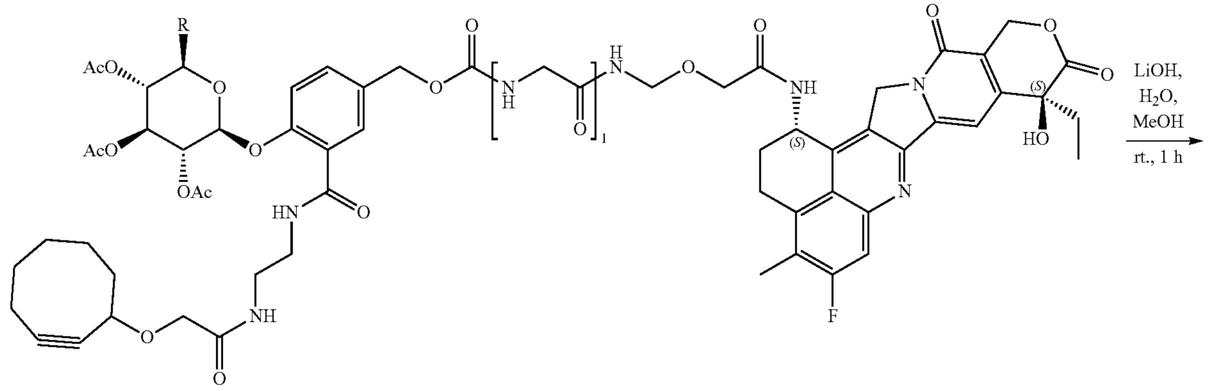
LP5-5, n = 1, R = $CO_2Me$
LP6-5, n = 1, R = $CH_2OAc$
LP12-5, n = 2, R = $CO_2Me$
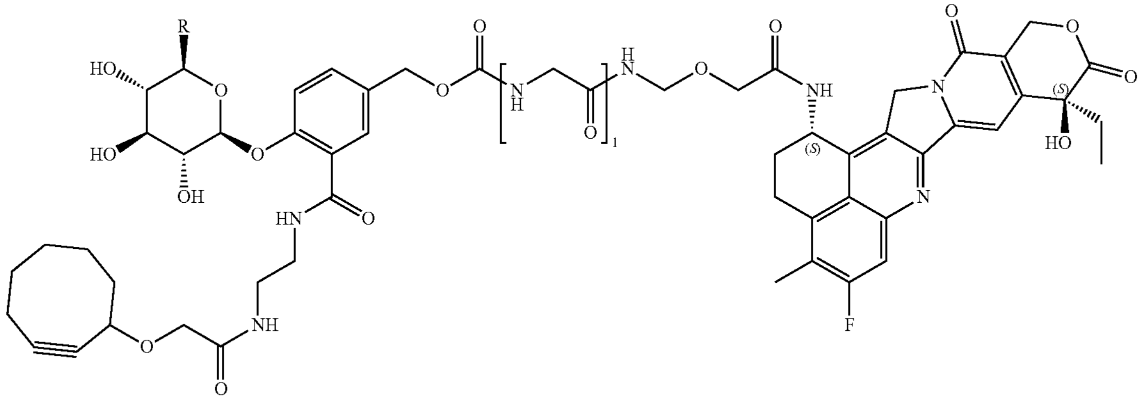
LP5, n = 1, R = $CO_2H$
LP6, n = 1, R = $CH_2OH$
LP12, n = 2, R = $CO_2H$
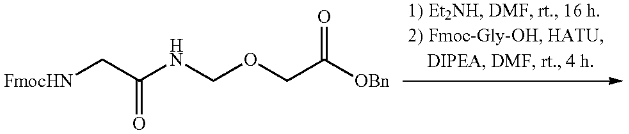
GP-1
1599440-07-9
WO 2014057687
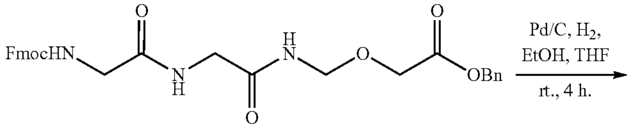
GP-2
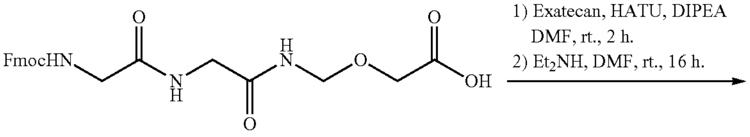
GP-3

-continued

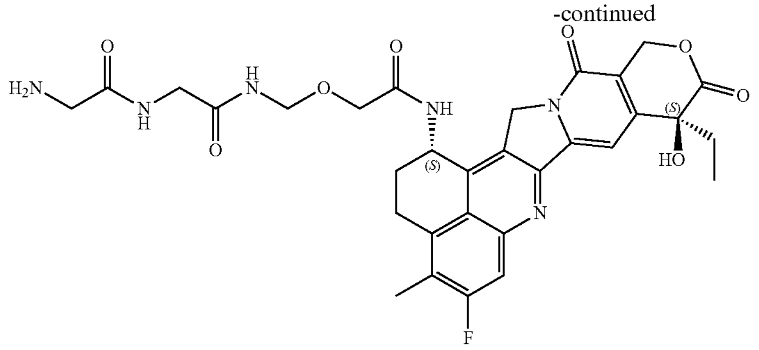

Gly-P

Example 6A: N-(2-Aminoethyl)-2-(cyclooct-2-yn-1-yloxy)acetamide (L5-1)

(L5-1)

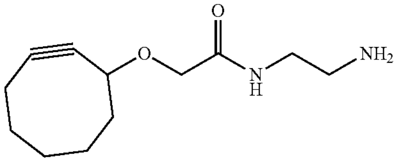

To a solution of ethylenediamine (0.71 g, 12 mmol) in DMF (2.0 mL) were added DIPEA (0.30 g, 2.4 mmol) and a solution of compound L3-2 (0.33 g, 1.2 mmol) in DMF (3.0 mL) slowly, and the mixture was stirred at RT for 30 min. Reaction completion was monitored by LCMS. The resulting mixture was purified by reversed phase flash chromatography (0-100% acetonitrile in aq. ammonium bicarbonate (0.8 mM)) to give compound L5-1 (0.18 g, 68% yield) as colorless oil. ESI m/z: 225.2 $(M+H)^+$. $^1H$ NMR (400 MHz, $DMSO_{d6}$) δ 7.74-7.63 (m, 1H), 4.28 (t, J=5.8 Hz, 1H), 3.88-3.73 (m, 2H), 3.11-3.00 (m, 4H), 2.58 (t, J=6.4 Hz, 2H), 2.27-2.06 (m, 3H), 1.94-1.71 (m, 4H), 1.66-1.54 (m, 2H), 1.45-1.33 (m, 1H) ppm.

Example 6B: Methyl (2S,3S,4S,5R,6S)-3,4,5-tris(acetyloxy)-6-[2-({2-[2-(cyclooct-2-yn-1-yloxy)acetamido]ethyl}carbamoyl)-4-(hydroxymethyl)phenoxy]oxane-2-carboxylate (L5-3)

(L5-3)

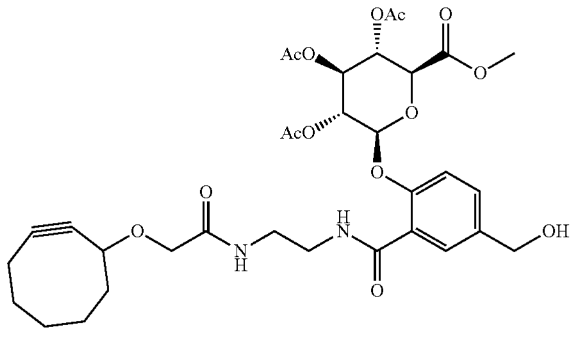

To a mixture of compound L5-2 (synthesized according to WO2018182341A1, incorporated by reference herein in its entirety) (0.11 g, 0.23 mmol) and HATU (96 mg, 0.25 mmol) in dry DMF (4 mL) were added compound L5-1 (51 mg, 0.23 mmol) and DIPEA (89 mg, 0.69 mmol), and the reaction mixture was stirred at RT for 2 hours until L5-2 was totally consumed, which was monitored by LCMS. The resulting mixture was directly purified by reversed phase flash chromatography (0-100% acetonitrile in aq. TFA (0.01%)) to give compound L5-3 (0.14 g, 90% yield) as a white solid. ESI m/z: 691.4 $(M+H)^+$. $^1H$ NMR (400 MHz, $CDCl_3$) δ 8.06-8.04 (m, 1H), 7.64-7.59 (m, 1H), 7.50-7.47 (m, 1H), 7.22-7.18 (m, 1H), 7.01-6.98 (m, 1H), 5.44-5.28 (m, 5H), 4.68 (s, 2H), 4.30-4.21 (m, 2H), 4.10-4.06 (m, 1H), 3.93-3.88 (m, 1H), 3.75 (s, 3H), 3.67-3.48 (m, 2H), 2.21-2.07 (m, 15H), 1.93-1.79 (m, 3H), 1.70-1.38 (m, 3H) ppm.

Example 6C: Methyl (2S,3S,4S,5R,6S)-3,4,5-tris(acetyloxy)-6-[2-({2-[2-(cyclooct-2-yn-1-yloxy)acetamido]ethyl}carbamoyl)-4-{[(4-nitrophenoxy-carbonyl)oxy]methyl}phenoxy]oxane-2-carboxylate (L5-4)

(L5-4)

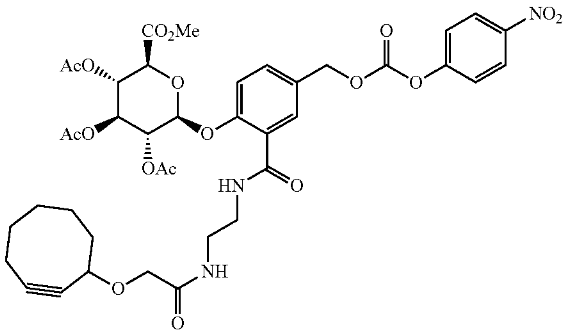

To a solution of compound L5-3 (0.14 g, 0.20 mmol) in DMF (2.0 mL) were added bis(4-nitrophenyl) carbonate (55 mg, 0.18 mmol) and DIPEA (26 mg, 0.20 mmol) at 0° C. under nitrogen. The reaction mixture was stirred at 0° C. for 30 min and then at RT for 3 hours. The reaction mixture was diluted with water (10 mL) and extracted with ethyl acetate (20 mL×3). The combined organic solution was washed with brine (10 mL), dried over anhydrous sodium sulfate and concentration in vacuo. The residue was purified by flash chromatography (40-60% ethyl acetate in petroleum ether) to give compound L5-4 (85 mg, 49% yield) as colorless oil. ESI m/z: 856.0 $(M+H)^+$.

Example 6D: Methyl (2S,3S,4S,5R,6S)-3,4,5-tris (acetyloxy)-6-[2-({2-[2-(cyclooct-2-yn-1-yloxy) acetamido]ethyl}carbamoyl)-4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20 (24)-heptaen-23-yl]carbamoyl}methoxy)methyl] carbamoyl}methyl) carbamoyl]oxy}methyl)phenoxy]oxane-2-carboxylate (L5-5)

(L5-5)

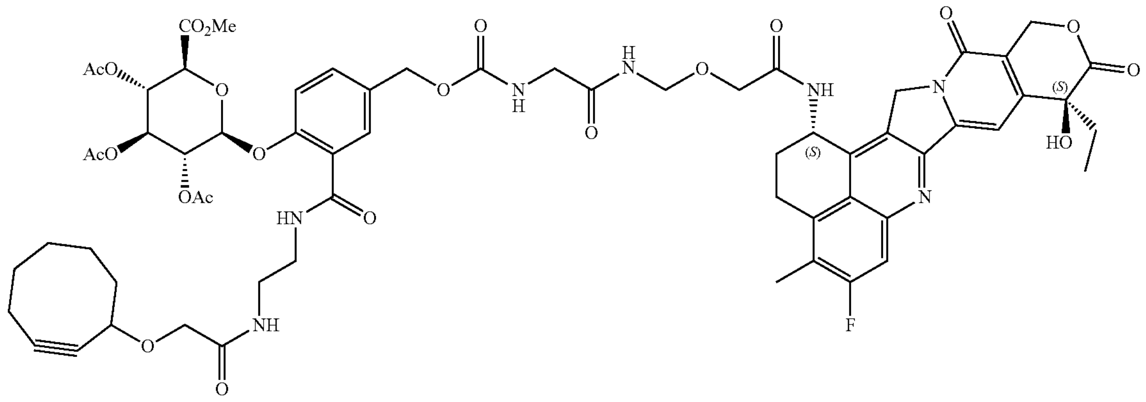

To a solution of compound L5-4 (17 mg, 20 μmol) in DMF (1.0 mL) were added P3 (12 mg, 20 μmol), HOBt (2.7 mg, 20 μmol) and DIPEA (5.1 mg, 40 μmol). The reaction mixture was stirred at RT for 16 hours, which was monitored by LCMS. The resulting mixture was directly purified by reversed phase flash chromatography (0-100% acetonitrile in aq. TFA (0.01%)) to give compound L5-5 (13 mg, 20% yield) as a yellow solid. ESI m/z: 649.0 $(M/2+H)^+$.

Example 6E: (2S,3S,4S,5R,6S)-6-[2-({2-[2-(Cyclooct-2-yn-1-yloxy)acetamido]ethyl}carbamoyl)-4-({[({[({[(10S,23S)-10-ethyl-18-fluoro-10-hydroxy-19-methyl-5,9-dioxo-8-oxa-4,15-diazahexacyclo [14.7.1.0$^{2}$, $^{14}$.0$^{4}$, $^{13}$.0$^{6}$, $^{11}$.0$^{20}$, $^{24}$]tetracosa-1,6(11), 12,14,16,18,20(24)-heptaen-23-yl] carbamoyl}methoxy)methyl]carbamoyl}methyl) carbamoyl]oxy}methyl)phenoxy]-3,4,5-trihydroxyoxane-2-carboxylic Acid (LP5)

(LP5)

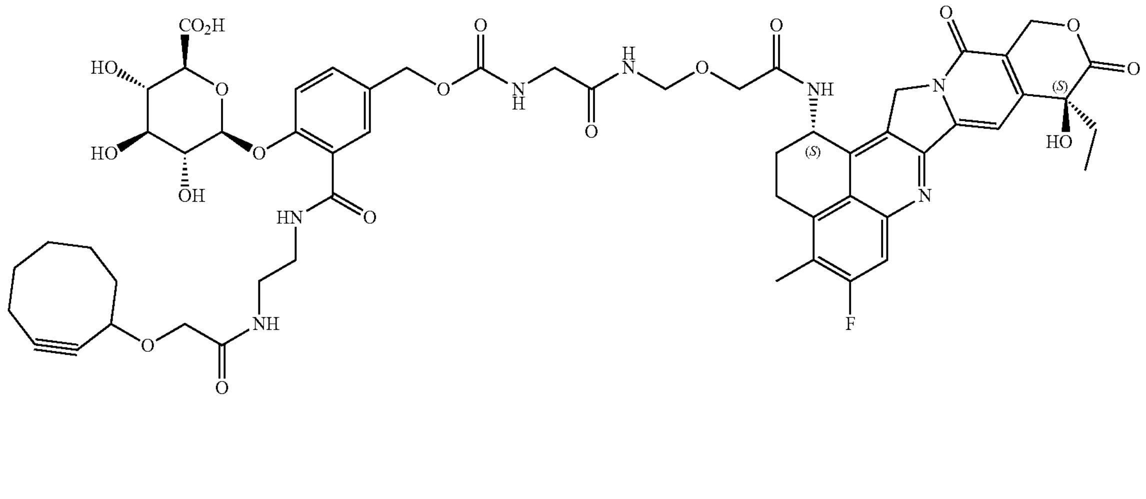

To a mixture of compound L5-5 (13 mg, 10 μmol) in methanol (2 mL) was added aq. lithium hydroxide (0.1 M, 2 mL), and the mixture was stirred at RT for an hour. Reaction completion was monitored by LCMS. After quenching with aq. HCl (1 N) to pH 4, the resulting mixture was purified by reversed phase flash chromatography (5-95% acetonitrile in aq. TFA (0.01%)) to give linker-payload LP5 (5 mg, 43% yield) as a white solid. ESI m/z: 1156.3 $(M+H)^+$.

Example 6F: [(2R,3R,4S,5R,6S)-3,4,5-Tris(acetyloxy)-6-[2-({2-[2-(cyclooct-2-yn-1-yloxy)acetamido]ethyl}carbamoyl)-4-(hydroxymethyl)phenoxy]oxan-2-yl]methyl acetate (L6-3)

(L6-3)

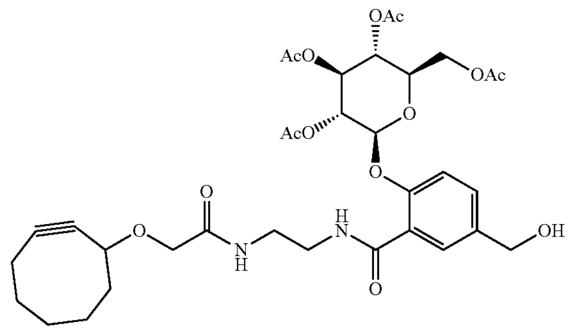

Following the procedure to make L5-3 except substituting L6-2 for L5-2, compound L6-3 (0.10 g, 80% yield) was obtained as a white solid. ESI m/z: 705.3 $(M+H)^+$.

Example 6G: [(2R,3R,4S,5R,6S)-3,4,5-Tris(acetyloxy)-6-[2-({2-[2-(cyclooct-2-yn-1-yloxy)acetamido]ethyl}carbamoyl)-4-{[(4-nitrophenoxycarbonyl)oxy]methyl}phenoxy]oxan-2-yl]methyl acetate (L6-4)

(L6-4)

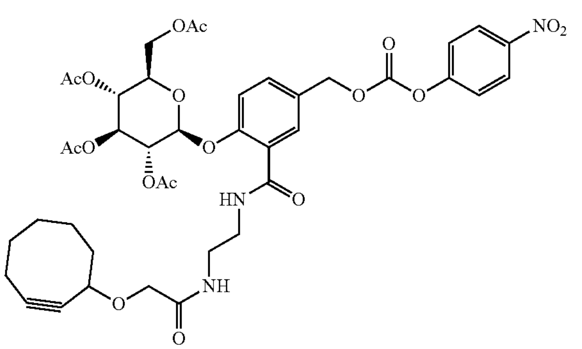

Following the procedure to make L5-4 except substituting L6-3 for L5-3, compound L6-4 (62 mg, 50% yield) was obtained as a white solid. ESI m/z: 870.3 $(M+H)^+$.

Example 6H: [(2R,3R,4S,5R,6S)-3,4,5-Tris(acetyloxy)-6-[2-({2-[2-(cyclooct-2-yn-1-yloxy)acetamido]ethyl}carbamoyl)-4-({[({[({[({[(10S,23S)-10-ethyl-18-fluoro-10-hydroxy-19-methyl-5,9-dioxo-8-oxa-4,15-diazahexacyclo[14.7.1.0$^2$, $^{14}$.0$^4$, $^{13}$.0$^6$, $^{11}$.0$^{20}$, $^{24}$]tetracosa-1,6(11),12,14,16,18,20(24)-heptaen-23-yl]carbamoyl}methoxy)methyl]carbamoyl}methyl) carbamoyl]oxy}methyl)phenoxy]oxan-2-yl]methyl acetate (L6-5)

(L6-5)

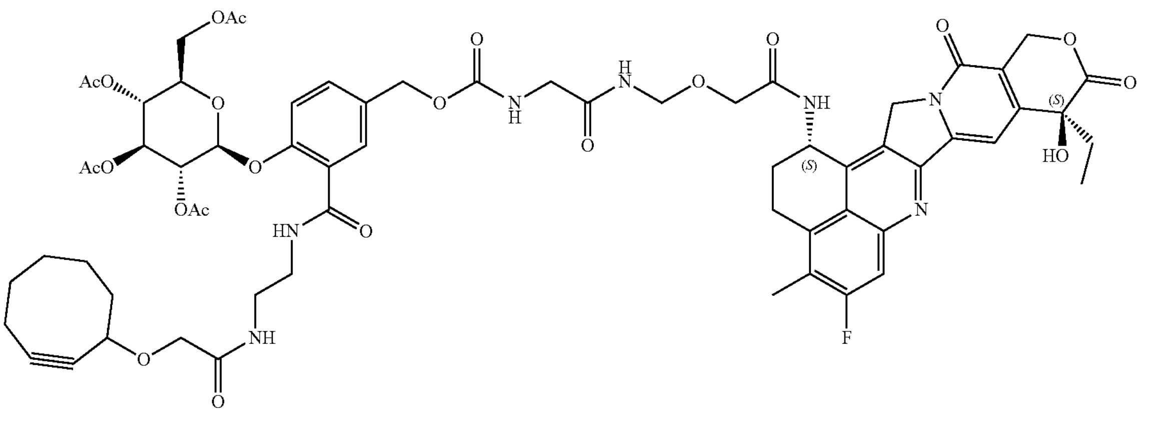

Following the procedure to make L5-5 except substituting L6-4 for L5-4, compound L6-5 (30 mg, 66% yield) was obtained as a white solid. ESI m/z: 655.7 $(M/2+H)^+$.

Example 6I: [3-({2-[2-(Cyclooct-2-yn-1-yloxy)acetamido]ethyl}carbamoyl)-4-{[(2S,3R,4S,5S,6R)-3,4,5-trihydroxy-6-(hydroxymethyl)oxan-2-yl]oxy}phenyl]methyl N-({[({[(10S,23S)-10-ethyl-18-fluoro-10-hydroxy-19-methyl-5,9-dioxo-8-oxa-4,15-diazahexacyclo[$14.7.1.0^{2}$, $^{14}.0^{4}$, $^{13}.0^{6}$, $^{11}.0^{20}$, $^{24}$]tetracosa-1,6(11),12,14,16,18,20(24)-heptaen-23-yl]carbamoyl}methoxy)methyl]carbamoyl}methyl)carbamate (LP6)

(LP6)

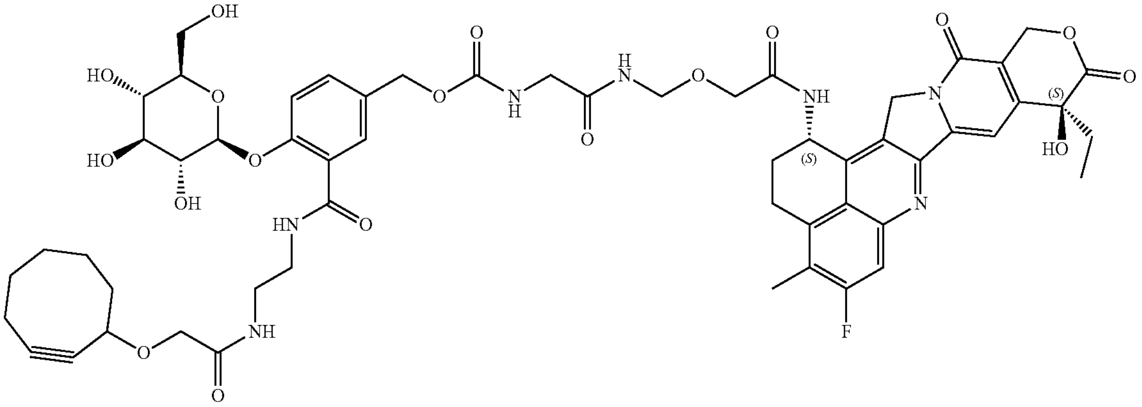

Following the procedure to make LP5 except substituting L6-5 for L5-5, linker-payload LP6 (9 mg, 34% yield) was obtained as a white solid. ESI m/z: 1142.3 $(M+H)^+$.

Example 6J: Benzyl 2-({2-[2-({[(9H-fluoren-9-yl)methoxy]carbonyl}amino) acetamido]acetamido}methoxy)acetate (GP-2)

(GP-2)

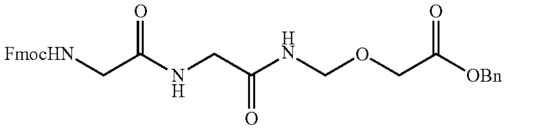

To a solution of compound GP-1 (CAS: 1599440-07-9, synthesized according to WO 2014057687, 0.20 g, 0.42 mmol) in DMF (5 mL) was added diethylamine (0.15 g, 2.1 mmol), and the reaction mixture was stirred at room temperature overnight, which was monitored by LCMS. The resulting mixture was directly separated by reversed phase flash chromatography (0-100% acetonitrile in aq. ammonium bicarbonate (0.05%)) to give a white solid (0.1 g, ESI m/z: 253.1), which was added into a mixture of Fmoc-glycine (0.14 g, 0.48 mmol) and HATU (0.23 g, 0.59 mmol) in DMF (5 mL), followed by the addition of DIPEA (0.15 g, 0.59 mmol). The reaction mixture was stirred at room temperature for 4 hours, which was monitored by LCMS. The resulting mixture was directly purified by prep-HPLC (10-95% acetonitrile in aq. TFA (0.05%)) to give compound GP-2 (0.14 g, 64% yield) as a white solid. ESI m/z: 554.3 $(M+Na)^+$.

Example 6K: 2-({2-[2-({[(9H-Fluoren-9-yl)methoxy]carbonyl}amino)acetamido]acetamido}methoxy)acetic Acid (GP-3)

(GP-3)

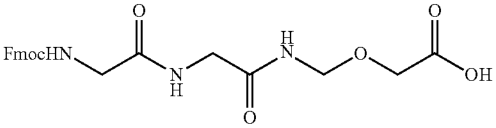

To a solution of compound P-2 (0.10 g, 0.19 mmol) in ethyl acetate (10 mL) was added palladium on carbon (0.10 g) under nitrogen protection. The reaction mixture was stirred under hydrogen balloon at room temperature for 4 hours, which was monitored by LCMS. The resulting mixture was filtered through celite and the filtrate was concentrated in vacuo to give compound GP-3 (56 mg, 65% yield) as a white solid. ESI m/z (weak): 464.0 $(M+Na)^+$.

Example 6L: 2-Amino-N-({[({[(10S,23S)-10-ethyl-18-fluoro-10-hydroxy-19-methyl-5,9-dioxo-8-oxa-4,15-diazahexacyclo[$14.7.1.0^{2}$, $^{14}.0^{4}$, $^{13}.0^{6}$, $^{11}.0^{20}$, $^{24}$]tetracosa-1,6(11),12,14,16,18,20(24)-heptaen-23-yl]carbamoyl}methoxy)methyl]carbamoyl}methyl)acetamide (Gly-P3)

(Gly-P3)

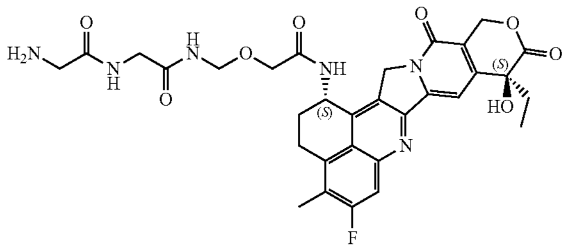

To a solution of compound GP-3 (41 mg, 93 μmol) in dry DMF (5 mL) were added HATU (39 mg, 0.10 mmol), exatecan (mesylate, 41 mg, 93 μmol) and DIPEA (36 mg, 0.28 mmol) successively, and the reaction mixture was stirred at room temperature for 2 hours, which was monitored by LCMS. The resulting mixture was separated by reversed phase flash chromatography (0-100% acetonitrile in aq. TFA (0.01%)) to give Fmoc-Gly-P3 (50 mg, 63% yield, ESI m/z: 859.0) as a white solid, which was dissolved in DMF (5 mL). To the solution was added diethylamine (20 mg, 0.27 mmol), and the mixture was stirred at room temperature overnight. The resulting mixture was separated by reversed phase flash chromatography (0-100% acetonitrile in aq. TFA (0.01%)) to give Gly-P3 (TFA salt, 40 mg, 57% yield from exatecan) as a white solid. ESI m/z: 637.3 $(M+H)^+$.

Example 6M: Methyl (2S,3S,4S,5R,6S)-3,4,5-tris(acetyloxy)-6-[2-({2-[2-(cyclooct-2-yn-1-yloxy)acetamido]ethyl}carbamoyl)-4-{[({[({[({[(10S,23S)-10-ethyl-18-fluoro-10-hydroxy-19-methyl-5,9-dioxo-8-oxa-4, 15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl) carbamoyl]methyl}carbamoyl)oxy]methyl}phenoxy]oxane-2-carboxylate (LP12-5)

(LP12-5)

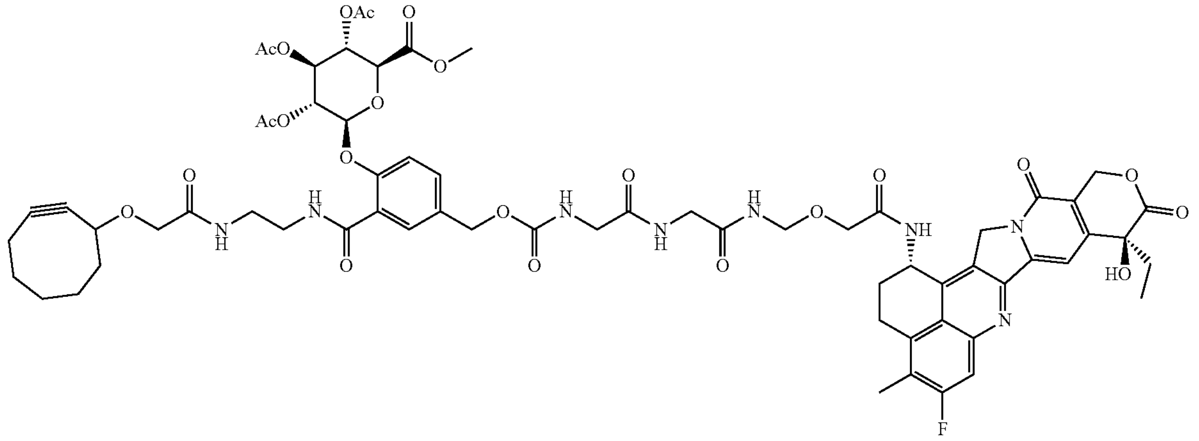

Following the similar procedure as LP10-5 except substituting Gly-P3 for P3, compound LP12-5 (23 mg, 39% yield) was obtained as a yellow solid. ESI m/z: 860.5 $(M-M_{DXD}+H)^+$, 677.4 $(M/2+H)^+$.

Example 6N: (2S,3S,4S,5R,6S)-6-[2-({2-[2-(Cyclooct-2-yn-1-yloxy)acetamido]ethyl}carbamoyl)-4-{[({[({[({[(10S,23S)-10-ethyl-18-fluoro-10-hydroxy-19-methyl-5,9-dioxo-8-oxa-4,15-diazahexacyclo [14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy) methyl]carbamoyl}methyl)carbamoyl]methyl}carbamoyl)oxy]methyl}phenoxy]-3,4,5-trihydroxyoxane-2-carboxylic Acid (LP12)

(LP12)

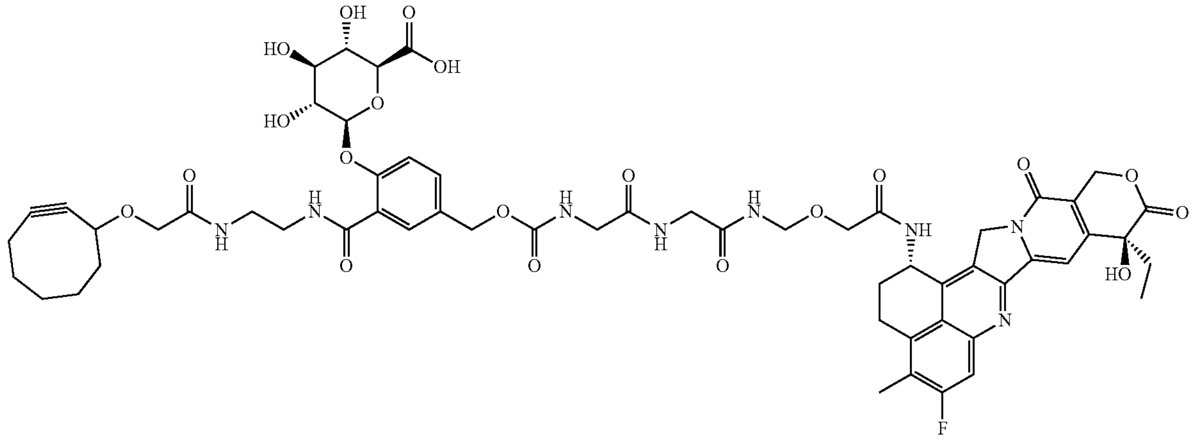

Following the similar procedure as LP10 except substituting LP12-5 for LP10-5, linker-payload LP12 (3 mg, 27% yield) was obtained as a white solid. ESI m/z: 607.4 (M/2+H)$^+$. $^1$H NMR (400 MHz, DMSO$_{d6}$) δ 8.72 (t, J=6.5 Hz, 1H), 8.62-8.49 (m, 2H), 8.19 (t, J=5.1 Hz, 1H), 7.98-7.90 (m, 1H), 7.82-7.71 (m, 2H), 7.53 (t, J=6.0 Hz, 1H), 7.47-7.41 (m, 1H), 7.37-7.28 (m, 2H), 6.56 (s, 1H), 5.69-5.55 (m, 2H), 5.43 (s, 2H), 5.20 (s, 3H), 4.99 (s, 2H), 4.89 (d, J=5.9 Hz, 1H), 4.63 (d, J=6.8 Hz, 2H), 4.31-4.23 (m, 1H), 4.01 (s, 2H), 3.87 (d, J=14.8 Hz, 1H), 3.78-3.61 (m, 4H), 3.29-3.12 (m, 5H), 2.39 (s, 3H), 2.26-2.10 (m, 4H), 2.06-1.96 (m, 2H), 1.94-1.78 (m, 4H), 1.77-1.65 (m, 2H), 1.61-1.42 (m, 3H), 1.38-1.18 (m, 6H), 0.90-0.83 (m, 3H) ppm. (The proton of acid was not revealed.) $^{19}$F NMR (376 MHz, DMSO$_{d6}$) δ −111.3 ppm.

Example 7: Synthesis of Branched Linker-Payloads (BL2P)

Example 7A: Synthesis of Branch Linker Key Intermediate II

The key intermediates II were synthesized as described in Scheme 8 and in Examples 7A-7B below. Scheme 9 provides commercial starting materials utilized in the syntheses.

Scheme 8. Synthesis of branch linker key intermediate II

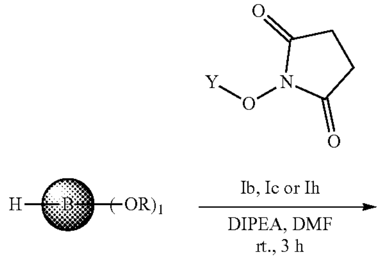

II2-1, R = Et, r = 2
II3-1, R = Et, r = 2
II4-1, R = Me, r = 2
II5-1, R = Me, r = 3

-continued

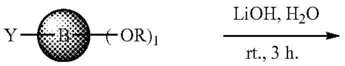

II2b-2, R = Et, r = 2
II2c-2, R = Et, r = 2
II3b-2, R = Et, r = 2
II3c-2, R = Et, r = 2
II4b-2, R = Me, r = 2
II4Ab-2, R = Me, r = 2II
5Ab-2, R = Me, r = 3

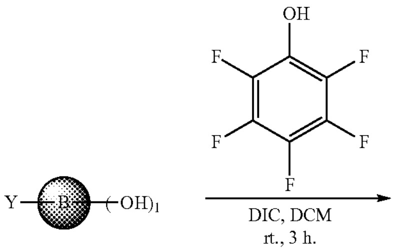

II2b-3, r = 2
II2c-3, r = 2
II3b-3, r = 2
II3c-3, r = 2
II4b-3, r = 2
II4Ab-3, r = 2
II5Ab-3, r = 3

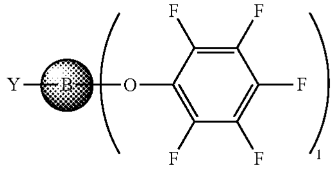

II2b, r = 2
II2c, r = 2
II3b, r = 2
II3c, r = 2
II4b, r = 2
II4Ab, r = 2
II5Ab, r = 3

TABLE 12

| Commercial OSu materials Ib, Ic and Ih: | | |
|---|---|---|
| Ib | 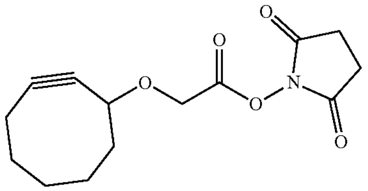 [SMILES: O=C(COC1C#CCCCCC1)ON1C(=O)CCC1=O] | 1425803-45-7 |
| Ic | 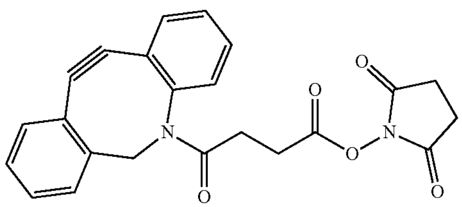 [SMILES: O=C(CCC(=O)N1Cc2ccccc2C#Cc2ccccc21)ON1C(=O)CCC1=O] | 1353016-71-3 |

TABLE 12-continued

| Commercial OSu materials Ib, Ic and Ih: | | |
|---|---|---|
| Ih | 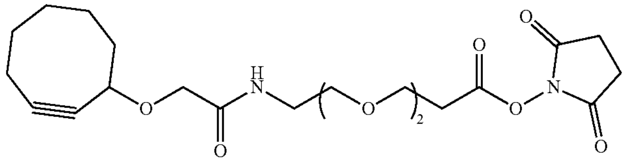 | 2101206-22-6 |

Example 7B: General Procedure for Intermediate II

To a solution of active ester I (1.0 equiv.) in DMF (0.4 M) were added DIPEA (3.0 equiv.) and branch amine II-1 (1.0 equiv.). The resulting mixture was stirred at room temperature for 3 hours, which was monitored by LCMS. The resulting mixture was directly purified by reversed phase flash chromatography (0-70% acetonitrile in water) to give II-2 as a white solid, which was dissolved in THF (0.5 M). To the solution were added water ($V_{H2O}$:$V_{THF}$=1:1) and lithium hydroxide hydrate (4 equiv. of II-2). The reaction mixture was stirred at room temperature for 3 hours, which was monitored by LCMS. The resulting mixture was directly separated by reversed phase flash chromatography (0-70% acetonitrile in water) to give compound II-3 as a white solid, which was dissolved in water (0.1 M). To the solution were added acetonitrile ($V_{acetonitrile}$:$V_{H2O}$=1:1), pentafluorophenol (2.0 equiv. of II-3) and DIC (2.0 equiv. of II-3), and the reaction mixture was stirred at room temperature for 3 hours, which was monitored by LCMS. The resulting mixture was directly purified by reversed phase flash chromatography (10-99% acetonitrile in water) to give key intermediate II as colorless oil.

TABLE 13

| Starting materials II#-1 and Branch-linker intermediates II | | | | | | | |
|---|---|---|---|---|---|---|---|
| Starting materials II#-1 | | | | Branch linker intermediates | | | |
| | | CAS | OSU | | | | ESI |
| # | Structure | Sources | # | # | Structures | yield | m/z |
| II2-1 | 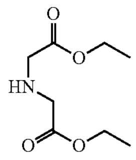 | 6290-05-7 Commercial | Ib | II2b | 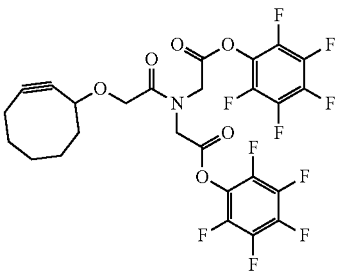 [SMILES: O=C(CN(CC(=O)Oc1c(F)c(F)c(F)c(F)c1F)C(=O)COC1C#CCCCCC1)Oc1c(F)c(F)c(F)c(F)c1F] | 17% | 630.2 (M + H)+, 652.2 (M + Na)+. |
| | | | Ic | II2c | 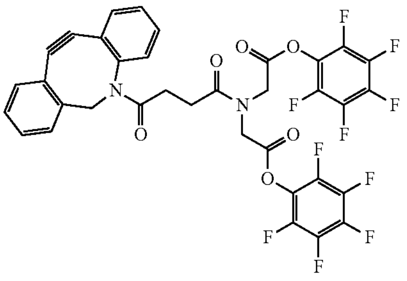 [SMILES: O=C(CN(CC(=O)Oc1c(F)c(F)c(F)c(F)c1F)C(=O)CCC(=O)N1Cc2ccccc2C#Cc2ccccc21)Oc1c(F)c(F)c(F)c(F)c1F] | 17% | 753.2 (M + H)+, 775.2 (M + Na)+ |
| II3-1 | 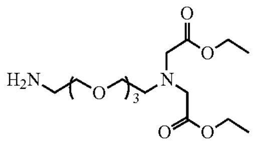 | 944163-34-2 Synthesized as Tetrahedron 63 (2007) 5539-5547 | Ib | II3b | 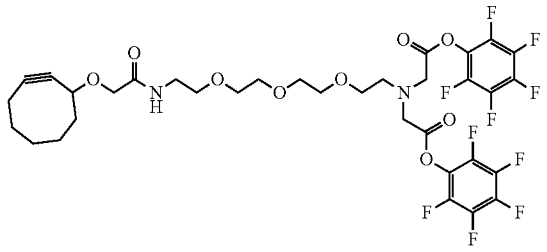 [SMILES: O=C(COC1C#CCCCCC1)NCCOCCOCCOCCN(CC(=O)Oc1c(F)c(F)c(F)c(F)c1F)CC(=O)Oc1c(F)c(F)c(F)c(F)c1F] | 24% | 805.3 (M + H)+, 827.3 (M + Na)+ |

TABLE 13-continued
| Starting materials II#-1 and Branch-linker intermediates II | | | | | | | |
|---|---|---|---|---|---|---|---|
| Starting materials II#-1 | | | | | Branch linker intermediates | | |
| | | CAS | OSU | | | | ESI |
| # | Structure | Sources | # | # | Structures | yield | m/z |
| | | | Ic | II3c | 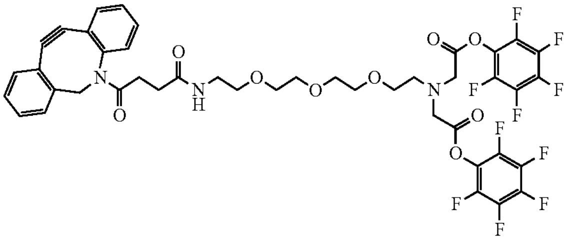 [SMILES: O=C(CCC(=O)N1Cc2ccccc2C#Cc2ccccc21)NCCOCCOCCOCCN(CC(=O)Oc1c(F)c(F)c(F)c(F)c1F)CC(=O)Oc1c(F)c(F)c(F)c(F)c1F] | 11% | 928.3 (M + H)$^+$ |
| II4-1 | 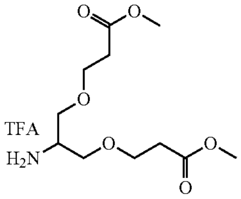 | 2404597-22-2 Synth-esized as WO2019 1998 | Ib | II4b | 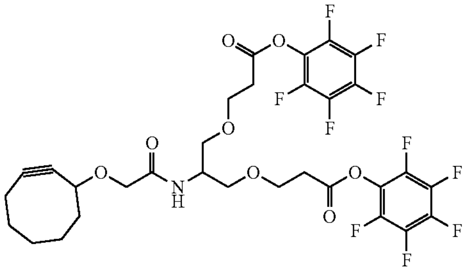 [SMILES: O=C(COC1C#CCCCCC1)NC(COCCC(=O)Oc1c(F)c(F)c(F)c(F)c1F)COCCC(=O)Oc1c(F)c(F)c(F)c(F)c1F] | 24% | 732.0 (M + H)$^+$, 754.0 (M + Na)$^+$ |
| | | | Ih | II4 Ab | 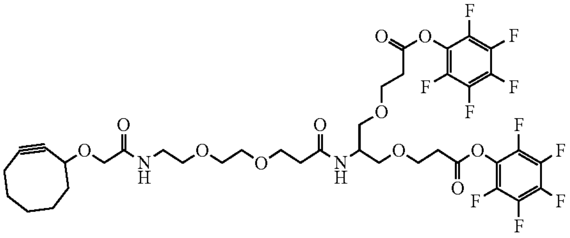 [SMILES: O=C(COC1C#CCCCCC1)NCCOCCOCCC(=O)NC(COCCC(=O)Oc1c(F)c(F)c(F)c(F)c1F)COCCC(=O)Oc1c(F)c(F)c(F)c(F)c1F] | 12% | 891.3 (M + H)$^+$, 913.3 (M + Na)$^+$ |
| II5-1 | 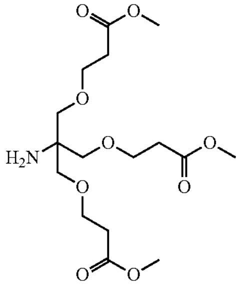 [SMILES: COC(=O)CCOCC(N)(COCCC(=O)OC)COCCC(=O)OC] | 166047-75-2 Synth-esized as WO2019 1998 21 | Ih | II5 Ab | 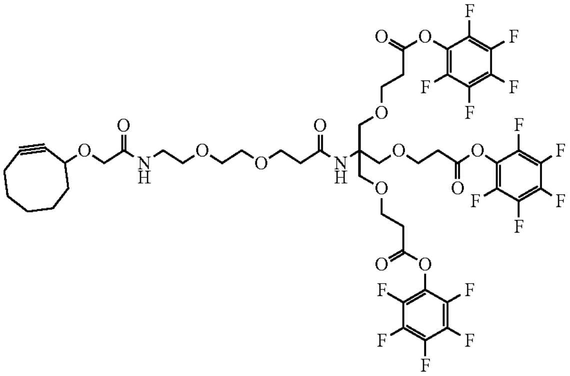 [SMILES: O=C(COC1C#CCCCCC1)NCCOCCOCCC(=O)NC(COCCC(=O)Oc1c(F)c(F)c(F)c(F)c1F)(COCCC(=O)Oc1c(F)c(F)c(F)c(F)c1F)COCCC(=O)Oc1c(F)c(F)c(F)c(F)c1F] | 12% | 1181.3 (M + Na)$^+$. |

Example 7C: Synthesis of Intermediate II3f

Scheme 9. Synthesis of branch linker intermediate II3f

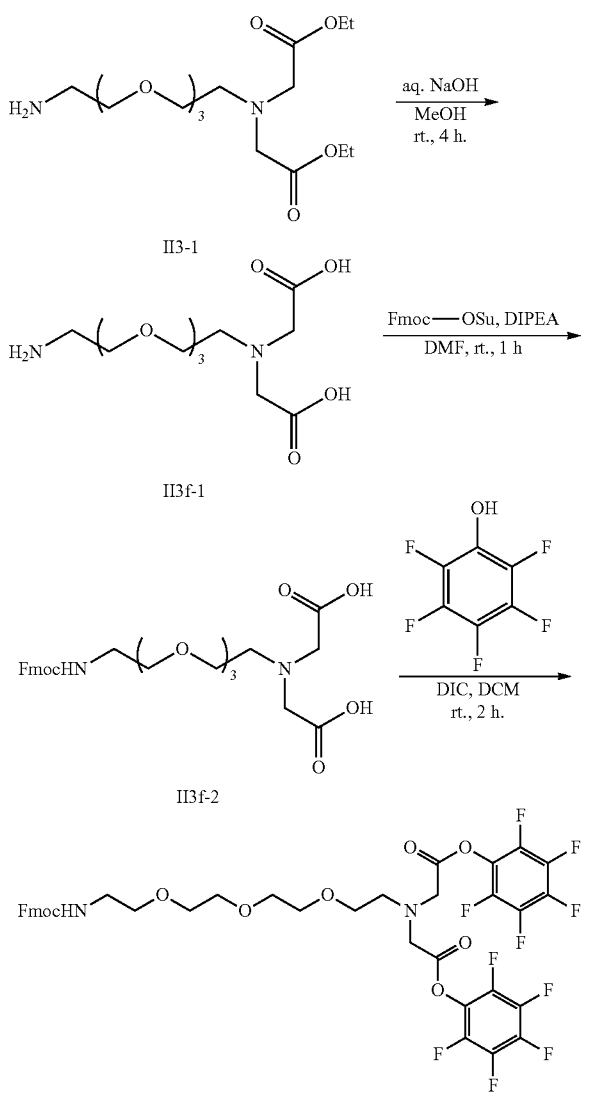

II3-1

II3f-1

II3f-2

II3-f 2,3,4,5,6-Pentafluorophenyl 1-({[(9H-fluoren-9-yl) methoxy]carbonyl}amino)-12-[2-oxo-2-(2,3,4,5,6-pentafluorophenoxy)ethyl]-3,6,9-trioxa-12-azatetradecan-14-oate (II3f)

(II3f)

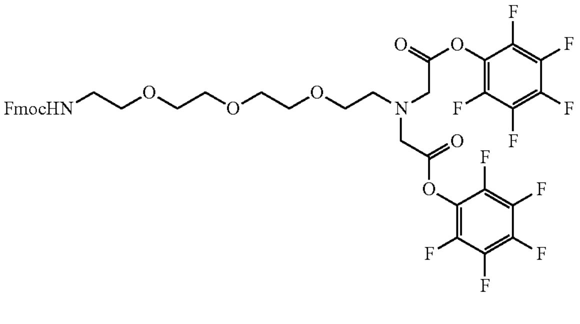

To a solution of 113-1 (2.6 g, 7.0 mmol) in methanol (20 mL) was added aq. sodium hydroxide (1.4 M, 20 mL), and the reaction mixture was stirred at room temperature for 4 hours, which was monitored by LCMS. The resulting mixture was washed with diluted aq. hydrochloride (1.0 M, 50 mL×3), water (100 mL) and brine (100 mL). The organic solution was dried over anhydrous sodium sulfate and concentrated in vacuo to give II3f-1 (2.2 g, crude) as colorless oil. ESI m/z: 309.3 $(M+H)^+$ To a solution of II3f-1 (0.10 g, crude) in DMF (10 mL) were added Fmoc-OSu (CAS: 82911-69-1, 0.11 g, 0.32 mmol) and DIPEA (0.13 g, 1.0 mmol), and the mixture was stirred at room temperature for an hour, which was monitored by LCMS. The resulting mixture was directly purified by reversed phase flash chromatography (0-100% acetonitrile in aq. TFA (0.03%)) to give II3f-2 (0.15 g, 90% yield) as a white solid. ESI m/z: 531.3 $(M+H)^+$.

To a mixture of II3f-2 (50 mg, 94 μmol) in DCM (10 mL) were added pentafluorophenol (35 mg, 0.19 mmol) and DIC (24 mg, 0.19 mmol), and the reaction mixture was stirred at room temperature for 2 hours, which was monitored by LCMS. The resulting mixture was concentrated in vacuo to give II3f (56 mg, 69% yield) as colorless oil, which was used directly without further purification. ESI m/z: 863.2 $(M+H)^+$.

Example 7D: Synthesis of Branched Linker-P3

Scheme 10. Synthesis of Linear vcPAB Linker-P (LP1, LP2, LP20, LP22, LP24) and Branch vcPAB Linker-P (LP24-31, LP36-38, LP41)

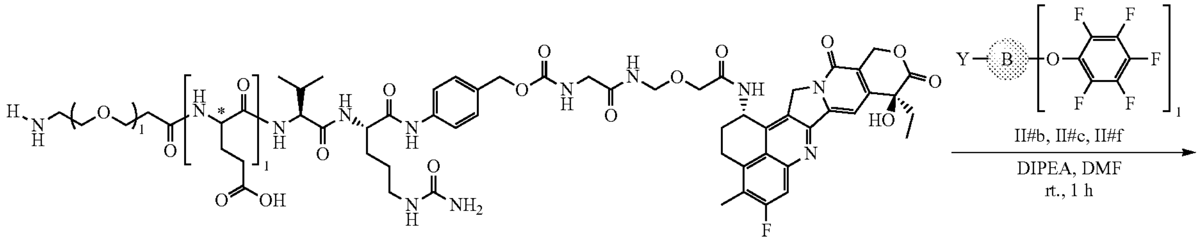

LP13, n = 0, m = 2
LP14, n = 1, *: R-, m = 2
LP15, n = 1, *: S-, m = 2
LP16, n = 0, m = 4

-continued
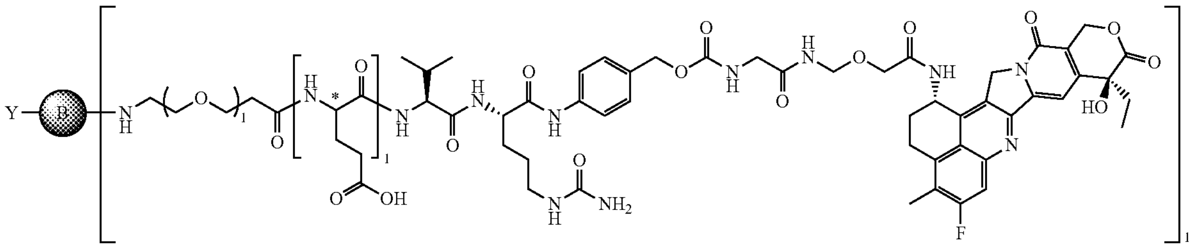
LP24, # = 2, Y = COT, n = 0, m = 2
LP25, # = 2, Y = COT, n = 1, *:R-, m = 2
LP26, # = 2, Y = DiBAC, n = 0, m = 4
$Et_2NH$ DMF
LP27f, # = 3, Y = Fmoc, n = 0, m = 2
LP27, # = 3, Y = H, n = 0, m = 2
LP28, # = 3, Y = COT, n = 1, *:R-, m = 2
LP30, # = 3, Y = DiBAC, n = 1, *:R-, m = 2
piperidine DMF
LP31f, # = 3, Y = Fmoc, n = 1, *S-, m = 2
LP31, # = 3, Y = H, n = 1, *:S-, m = 2
LP32, # = 3, Y = COT, n = 1, *:S-, m = 2
LP34, # = 3, Y = DiBAC, n = 1, *:S-, m = 2
LP36, # = 4, Y = COT, n = 1, *:R-, m = 2
LP37, # = 4, Y = COT, n = 1, *:S-, m = 2
LP38, # = 4A, Y = COT, n = 1, *:S-, m = 2
LP41, # = 5, Y = COT, n = 1, *S-, m = 2
b: Y =
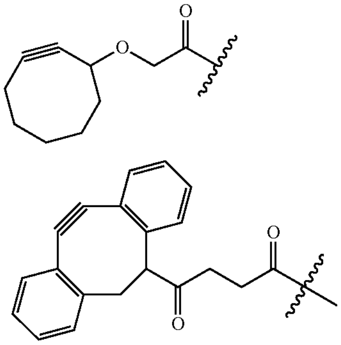
c: Y =
f: Y = Fmoc
\# = 2, r = 2, B =
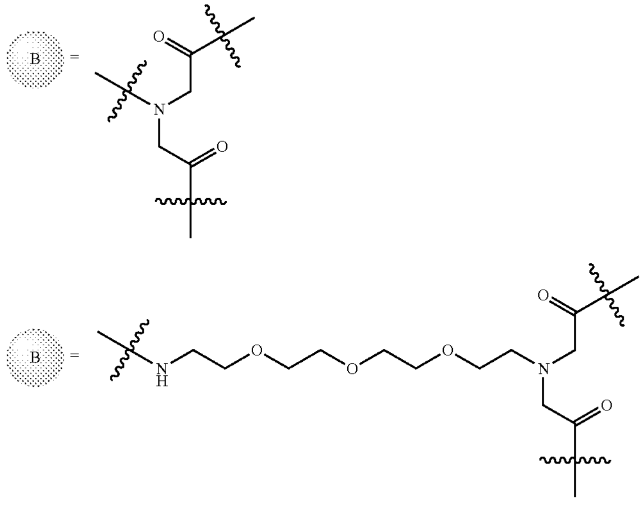
\# = 3, r = 2, B =

-continued

# = 4, r = 2,

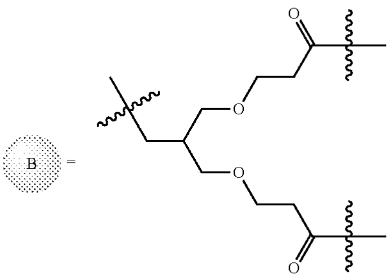

# = 4A, r = 2,

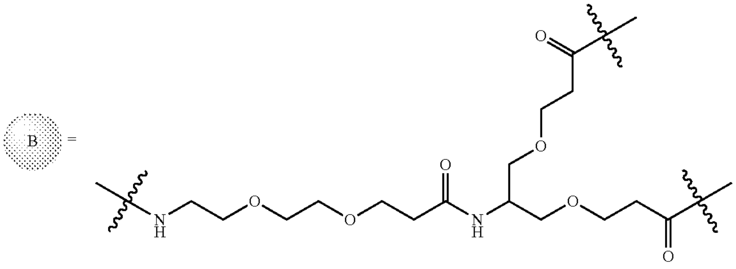

# = 5A, r = 3,

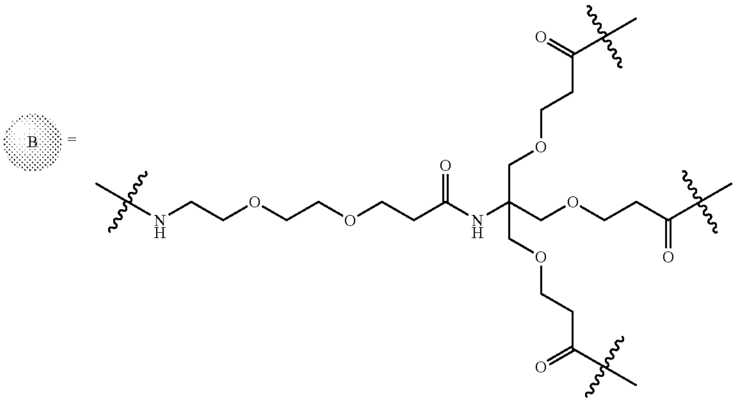

Example 7E: General Procedure for LP24-LP42

To a solution of intermediate II (1 equiv.) in DMF (3 mM) were added DIPEA (10 equiv.) and amino linker-payload (2-3 equiv., except 4.0 equiv. for LP41), and the reaction mixture was stirred at room temperature for an hour until amino linker-payload was totally consumed, which was monitored by LCMS. The resulting mixture was purified by prep-HPLC to provide branched linker-payload as a white solid.

Example 7F: {4-[(2S)-5-(Carbamoylamino)-2-[(2S)-2-(3-{2-[2-(2-{N-[({2-[2-(2-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[$14.7.1.0^{2}$, $^{14}.0^{4}$, $^{13}.0^{6}$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}ethoxy)ethoxy]ethyl}carbamoyl)methyl]-2-(cyclooct-2-yn-1-yloxy)acetamido}acetamido)ethoxy]ethoxy}propanamido)-3-methylbutanamido]pentanamido]phenyl}methyl N-({[({[(10S,23S)-10-ethyl-18-fluoro-10-hydroxy-19-methyl-5,9-dioxo-8-oxa-4,15-diazahexacyclo[$14.7.1.0^{2}$, $^{14}.0^{4}$, $^{13}.0^{6}$, $^{11}.0^{20}$, $^{24}$]tetracosa-1,6(11), 12,14,16,18,20(24)-heptaen-23-yl]carbamoyl}methoxy)methyl]carbamoyl}methyl)carbamate (LP24)

(LP24)
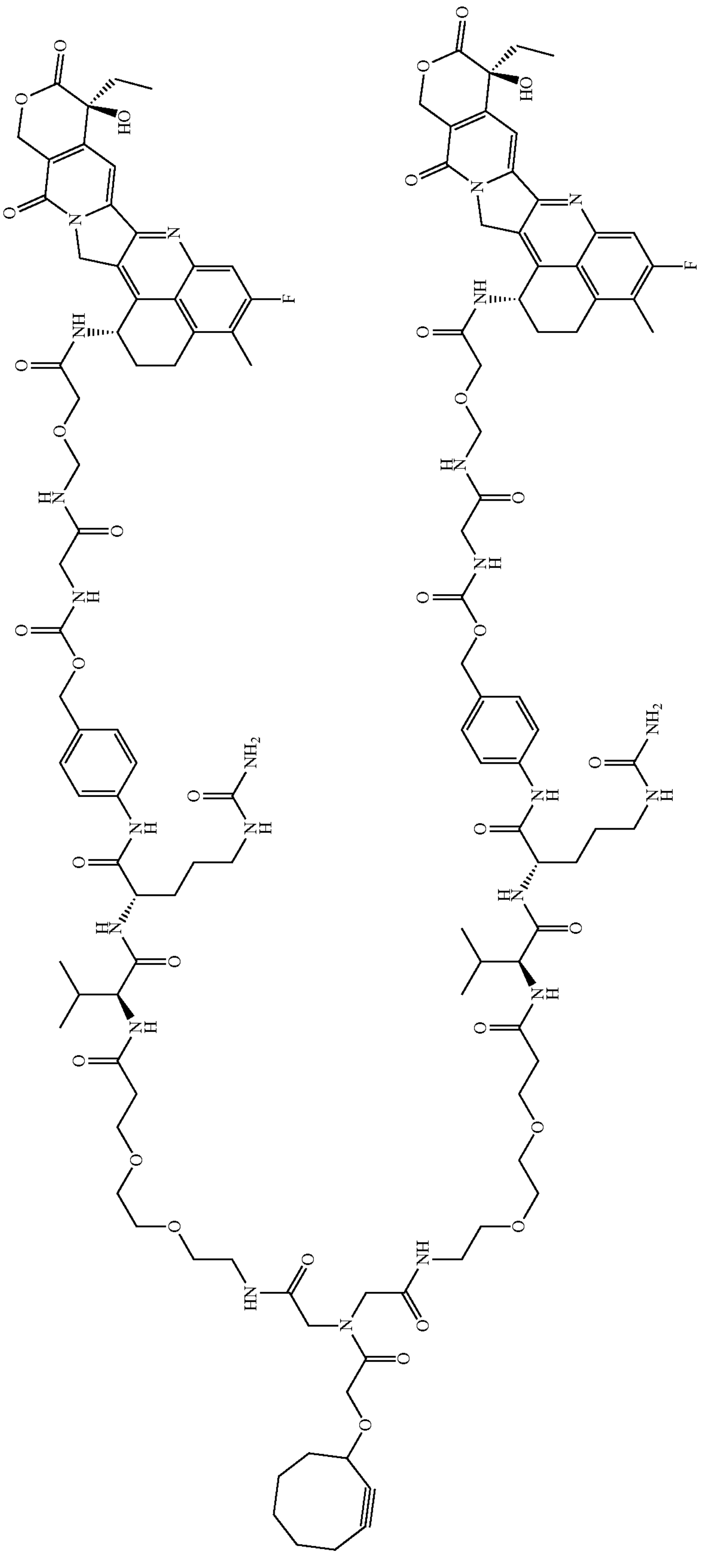

Following the general procedure from LP13 (42 mg, 32 μmol) and intermediate II2b (10 mg, 16 μmol), branched linker-payload LP24 (20 mg, 44% yield) was obtained as a white solid after purification by prep-HPLC (5-95% acetonitrile in aq. TFA (0.05%)). ESI m/z: 850.8 $(M/3+H)^+$. $^1H$ NMR (400 MHz, $DMSO_{d6}$) δ 10.0 (s, 2H), 8.81-8.78 (m, 2H), 8.64 (d, J=5.6 Hz, 1H), 8.50 (d, J=9.2 Hz, 2H), 8.25 (d, J=4.8 Hz, 1H), 8.13 (d, J=7.2 Hz, 2H), 7.88 (d, J=8.8 Hz, 2H), 7.78 (d, J=10.4 Hz, 2H), 7.58 (d, J=8.4 Hz, 4H), 7.42 (t, J=6.0 Hz, 2H), 7.31 (s, 2H), 7.27 (d, J=8.4 Hz, 4H), 6.03-5.96 (m, 2H), 5.62-5.57 (m, 2H), 5.46-5.36 (m, 6H), 5.24-5.14 (m, 4H), 4.92 (s, 4H), 4.63 (d, J=6.4 Hz, 4H), 4.42-4.35 (m, 2H), 4.27-4.22 (m, 3H), 4.14 (d, J=14.4 Hz, 1H), 4.02-3.99 (m, 6H), 3.94 (d, J=14.0 Hz, 1H), 3.87 (s, 2H), 3.63-3.57 (m, 9H), 3.51-3.46 (m, 8H), 3.25-3.18 (m, 6H), 3.18-3.05 (m, 2H), 3.02-2.98 (m, 2H), 2.98-2.89 (m, 2H), 2.47-2.45 (m, 2H), 2.41-2.35 (m, 8H), 2.23-2.12 (m, 8H), 2.03-1.91 (m, 4H), 1.86-1.76 (m, 8H), 1.76-1.63 (m, 4H), 1.63-1.51 (m, 5H), 1.45-1.32 (m, 6H), 0.88-0.81 (m, 18H) ppm. (Proton of CF3COOH was not revealed) $^{19}F$ NMR (376 MHz, $DMSO_{d6}$) δ −111, −74 ppm.

Example 7G: (4R)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[$14.7.1.0^2, {}^{14}.0^4, {}^{13}.0^6, {}^{11}.0^{20}, {}^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-(3-{2-[2-(2-{N-[({2-[2-(2-{[(1R)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[$14.7.1.0^2, {}^{14}.0^4, {}^{13}.0^6, {}^{11}.0^{20}, {}^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)methyl]-2-(cyclooct-2-yn-1-yloxy)acetamido}acetamido)ethoxy]ethoxy}propanamido)butanoic Acid (LP25)

((LP25))
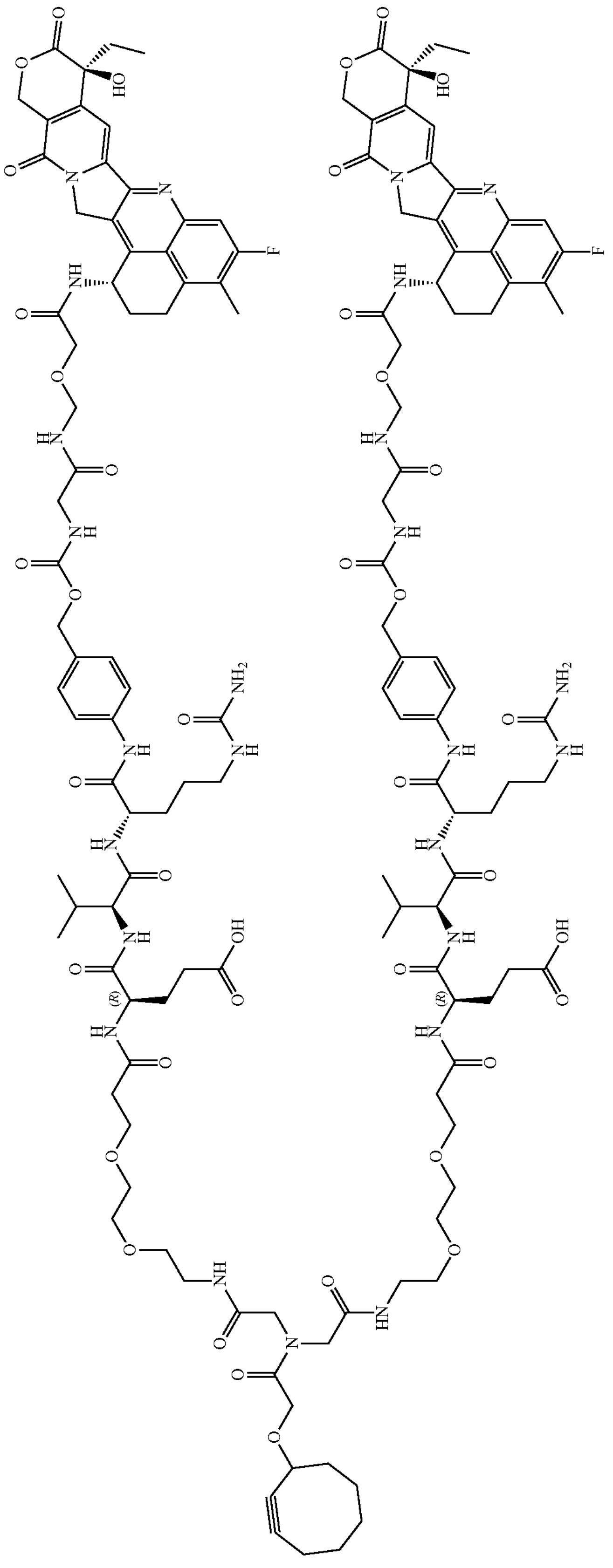

Following the general procedure from LP13 (24 mg, 19 μmol) and intermediate II2b (4.0 mg, 6.4 μmol), branched linker-payload LP25 (6 mg, 33% yield) was obtained as a white solid after purification by prep-HPLC (10-95% acetonitrile in aq. TFA (0.05%)). ESI m/z: 936.7 $(M/3+H)^+$. 1H NMR (400 MHz, $DMSO_{d6}$) δ 59.79 (br s, 2H), 8.80 (t, J=6.4 Hz, 2H), 8.69 (br s, 1H), 8.51 (d, J=8.4 Hz, 2H), 8.33-8.26 (m, 2H), 8.18-8.14 (m, 2H), 8.12-8.06 (m, 2H), 7.78 (d, J=11.2 Hz, 2H), 7.63-7.59 (m, 4H), 7.43 (t, J=6.0 Hz, 2H), 7.30 (s, 2H), 7.27 (d, J=8.0 Hz, 4H), 6.53 (br s, 2H), 6.08-6.01 (m, 2H), 5.62-5.57 (m, 2H), 5.48-5.44 (m, 4H), 5.41 (s, 4H), 5.19 (s, 4H), 4.92 (s, 4H), 4.63 (d, J=6.4 Hz, 4H), 4.37-4.31 (m, 4H), 4.27-4.11 (m, 5H), 4.03-3.98 (m, 6H), 3.96-3.91 (m, 1H), 3.86 (s, 2H), 3.64-3.60 (m, 4H), 3.53-3.49 (m, 2H), 3.47-3.42 (m, 10H), 3.25-3.18 (m, 8H), 3.15-3.10 (m, 2H), 3.04-2.92 (m, 5H), 2.38 (s, 8H), 2.21-2.11 (m, 12H), 2.07-1.98 (m, 4H), 1.88-1.75 (m, 13H), 1.67-1.61 (m, 2H), 1.57-1.53 (m, 2H), 1.47-1.34 (m, 6H), 0.89-0.81 (m, 20H) ppm. $^{19}F$ NMR (376 MHz, $DMSO_{d6}$) −71.08, −111.30 ppm.

Example 7H: {4-[(2S)-2-[(2S)-2-{1-[2-(4-{2-Azatricyclo[10.4.0.0$^{4}$, $^{9}$]hexadeca-1(12),4(9),5,7,13,15-hexaen-10-yn-2-yl}-N-{[(14-{[(1S)-1-{[(1S)-4-(carbamoylamino)-1-{[4-({[({[({[(10 S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl) carbamoyl]oxy}methyl)phenyl]carbamoyl}butyl]carbamoyl}-2-methylpropyl]carbamoyl}-3,6,9,12-tetraoxatetradecan-1-yl)carbamoyl]methyl}-4-oxobutanamido)acetamido]-3,6,9,12-tetraoxapentadecan-15-amido}-3-methylbutanamido]-5-(carbamoylamino)pentanamido]phenyl}methyl N-({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1-6(11),12,14,16,18,20(24)-heptaen-23-yl]carbamoyl}methoxy)methyl]carbamoyl}methyl)carbamate (LP26)

(LP26)
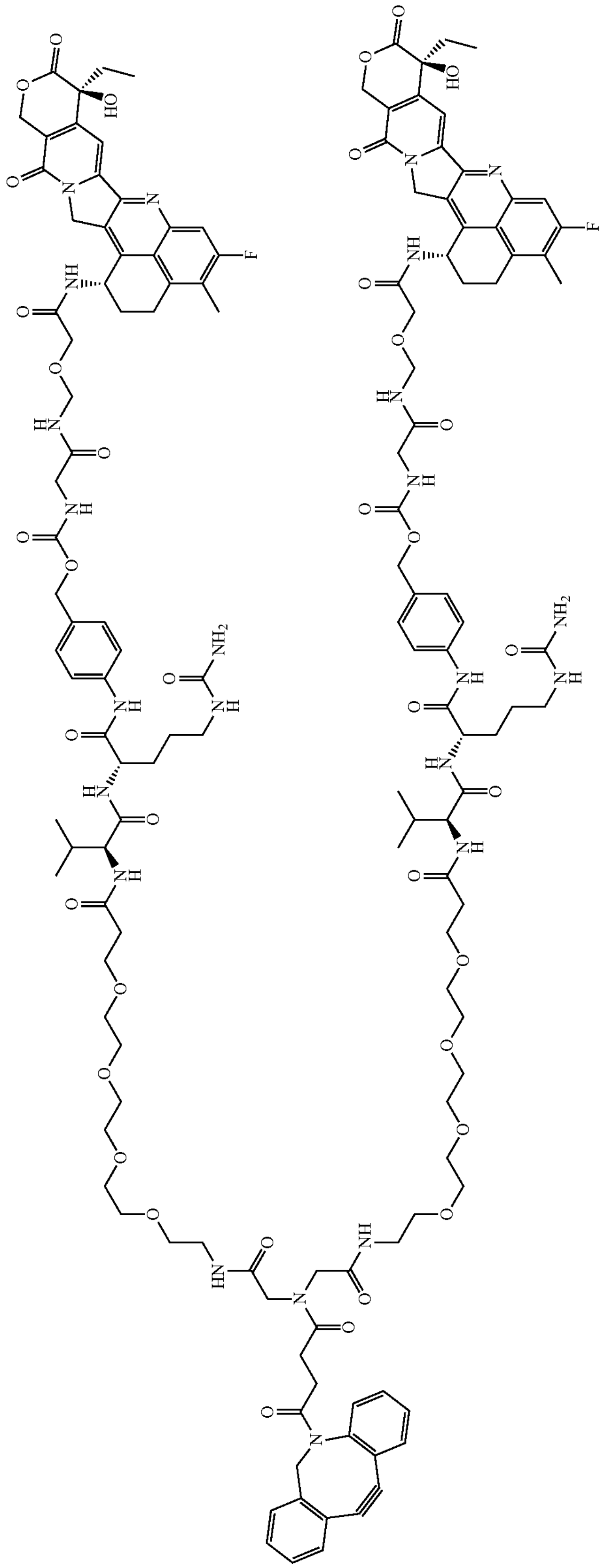

Following the general procedure from LP16 (6.0 mg, 4.8 μmol) and intermediate 112c (2.0 mg, 1.6 μmol), branched linker-payload LP26 (5 mg, 65% yield) was obtained as a light yellow solid after purification by prep-HPLC (10-95% acetonitrile in aq. formic acid (0.01%)). ESI m/z: 717.3 $(M/4+H)^+$ (E-ring-open form, Rt=6.38 minute, 14%); 950.2 $(M/3+H)^+$, 712.9 $(M/4+H)^+$ (lactone form, Rt=7.10 min, 86%). $^1$H NMR (400 MHz, $DMSO_{d6}$) δ 9.99 (s, 2H), 8.80 (t, J=6.8 Hz, 2H), 8.68-8.64 (m, 1H), 8.50 (d, J=8.8 Hz, 2H), 8.20 (t, J=6.4 Hz, 1H), 8.13 (d, J=7.6 Hz, 2H), 7.88 (d, J=8.4 Hz, 2H), 7.78 (d, J=10.8 Hz, 2H), 7.69 (d, J=7.6 Hz, 1H), 7.61-7.57 (m, 5H), 7.50-7.41 (m, 5H), 7.37-7.26 (m, 9H), 6.53 (s, 2H), 5.98 (t, J=5.6 Hz, 2H), 5.62-5.57 (m, 2H), 5.45-5.36 (m, 8H), 5.19 (s, 4H), 5.01 (d, J=14.4 Hz, 1H), 4.92 (s, 4H), 4.63 (d, J=6.0 Hz, 4H), 4.41-4.35 (m, 2H), 4.23 (t, J=8.0 Hz, 2H), 4.02 (s, 4H), 3.95-3.81 (m, 3H), 3.62-3.56 (m, 8H), 3.47-3.44 (m, 24H), 3.22-3.17 (m, 6H), 3.05-2.98 (m, 2H), 2.93-2.88 (m, 2H), 2.64-2.58 (m, 2H), 2.39-2.35 (m, 8H), 2.22-2.11 (m, 6H), 2.00-1.82 (m, 9H), 1.79-1.53 (m, 9H), 1.49-1.31 (m, 6H), 0.86-0.81 (m, 18H) ppm. $^{19}$F NMR (376 MHz, $DMSO_{d6}$) δ −111 ppm.

Example 7I: (9H-Fluoren-9-yl)methyl N-[1-({2-[2-(2-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[$14.7.1.0^2$, $^{14}.0^4$, $^{13}.0^6$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}ethoxy)ethoxy]ethyl}carbamoyl)-2-[({2-[2-(2-{[(1S)-1-{[(1S)-4-(carbamoylamino)-1-{[4-({[({[({[(10S,23S)-10- ethyl-18-fluoro-10-hydroxy-19-methyl-5,9-dioxo-8-oxa-4,15-diazahexacyclo[$14.7.1.0^2$, $^{14}.0^4$, $^{13}.0^6$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}ethoxy)ethoxy]ethyl}carbamoyl)methyl]-5,8,11-trioxa-2-azatridecan-13-yl]carbamate (LP27f)

(LP27f)
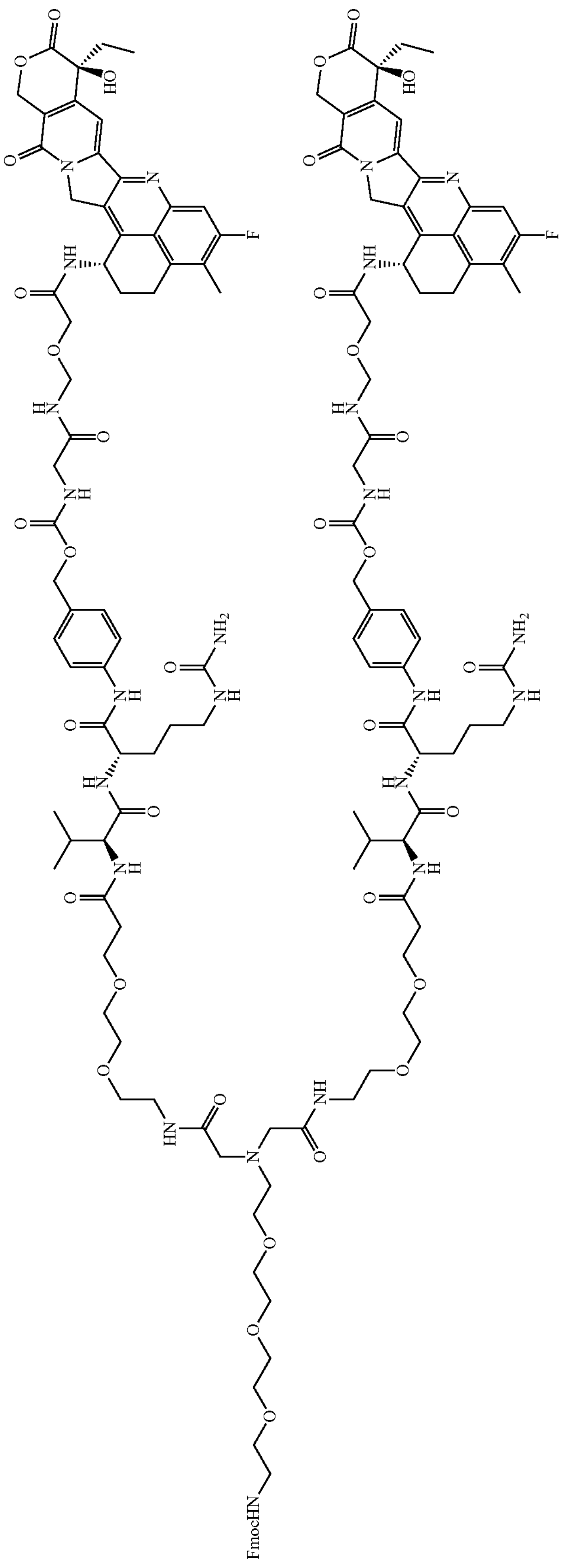

Following the general procedure from LP13 (67 mg, 58 μmol) and intermediate II3f (16 mg, 19 μmol), compound LP27f (21 mg, 39% yield) was obtained as a white solid after purification by reversed phase flash chromatography (0-100% acetonitrile in aq. TFA (0.05%)). ESI m/z: 1392.2 $(M/2+H)^+$.

Example 7J: {4-[(2S)-2-[(2 S)-2-{3-[2-(2-{1-Amino-12-[({2-[2-(2-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo [$14.7.1.0^2$, $^{14}.0^4$, $^{13}.0^6$, $^{11}.0^{20}$, $^{24}$]tetracosa-1,6(11),12,14,16,18,20(24)-heptaen-23-yl]carbamoyl}methoxy)methyl] carbamoyl}methyl)carbamoyl]oxy}methyl)phenyl] carbamoyl}butyl]carbamoyl}-2-methyl propyl] carbamoyl}ethoxy)ethoxy]ethyl}carbamoyl)methyl]-3,6,9-trioxa-12-azatetradecan-14-amido}ethoxy) ethoxy]propanamido}-3-methylbutanamido]-5-(carbamoylamino)pentanamido]phenyl}methyl N-({[({[(10S,23S)-10-ethyl-18-fluoro-10-hydroxy-19-methyl-5,9-dioxo-8-oxa-4,15-diazahexacyclo [$14.7.1.0^2$, $^{14}.0^4$, $^{13}.0^6$, $^{11}.0^{20}$, $^{24}$]tetracosa-1,6(11), 12,14,16,18,20(24)-heptaen-23-yl] carbamoyl}methoxy)methyl]carbamoyl}methyl) carbamate (LP27)

(LP27)
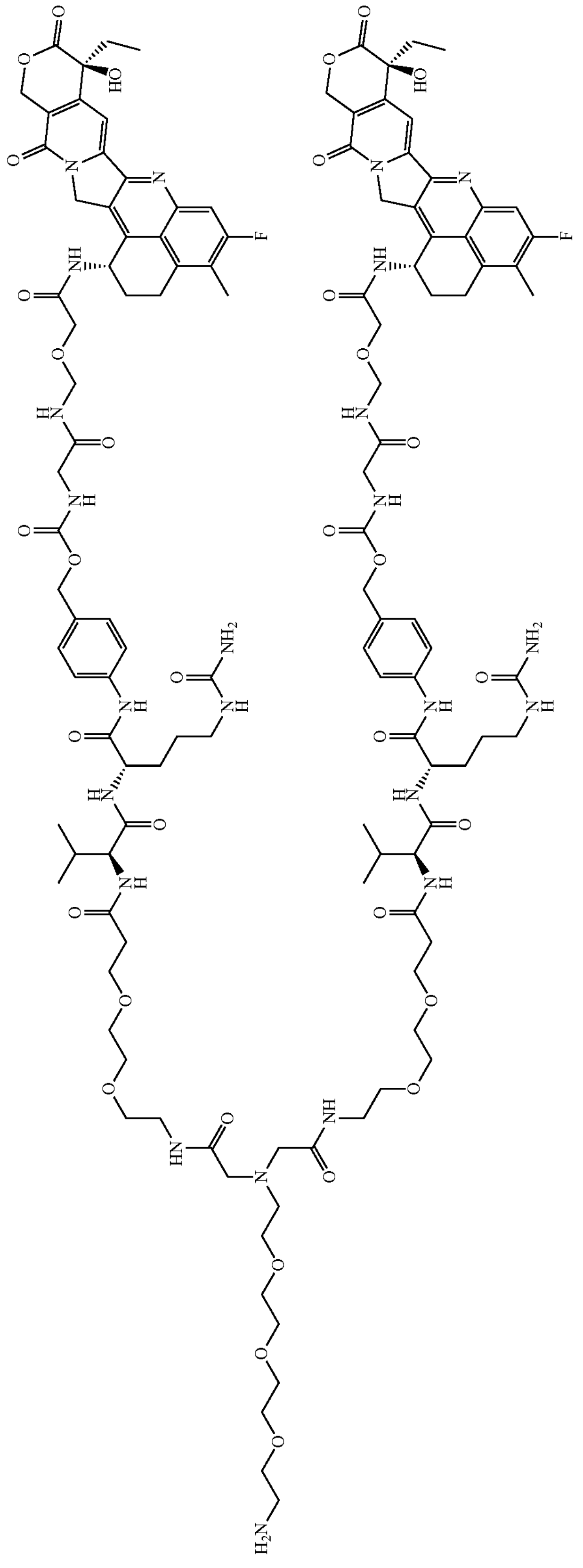

To a solution of compound LP27f (21 mg, 7.5 μmol) in DMF (5 mL) was added diethylamine (3 mg, 38 μmol), and the mixture was stirred at room temperature for 2 hours until Fmoc was totally removed according to LCMS. The resulting mixture was separated by reversed phase flash chromatography (0-100% acetonitrile in aq. TFA (0.01%)) to give LP27 (12 mg, 60% yield) as a white solid. ESI m/z: 1280.9 $(M/2+H)^+$, 854.3 $(M/3+H)^+$. $^1$H NMR (400 MHz, $DMSO_{d6}$) δ 10.02 (s, 1H), 8.84-8.77 (m, 2H), 8.51 (d, J=9.0 Hz, 2H), 8.24-8.14 (m, 3H), 8.10-8.04 (m, 2H), 7.91 (d, J=9.0 Hz, 2H), 7.78 (d, J=11.1 Hz, 2H), 7.63-7.55 (m, 3H), 7.46-7.40 (m, 2H), 7.32-7.24 (m, 4H), 6.53 (s, 2H), 6.05-5.99 (m, 2H), 5.65-5.55 (m, 3H), 5.43 (dd, J=11.8, 1.3 Hz, 6H), 5.19 (s, 3H), 4.92 (s, 3H), 4.70-4.55 (m, 3H), 4.40-4.35 (m, 2H), 4.26-4.20 (m, 2H), 4.01 (s, 3H), 3.70-3.37 (m, 42H), 3.25-3.21 (m, 5H), 3.16 (s, 6H), 3.05-2.98 (m, 3H), 2.97-2.89 (m, 4H), 2.69-2.62 (m, 3H), 2.42-2.30 (m, 9H), 2.22-2.11 (m, 5H), 2.00-1.92 (m, 3H), 1.88-1.79 (m, 4H), 1.74-1.65 (m, 3H), 1.63-1.54 (m, 3H), 1.49-1.27 (m, 7H), 0.91-0.78 (m, 11H) ppm. (protons of TFA were not revealed)

Example 7K: (4R)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-{3-[2-(2-{12-[({2-[2-(2-{[(1R)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)methyl]-1-[2-(cyclooct-2-yn-1-yloxy)acetamido]-3,6,9-trioxa-12-azatetradecan-14-amido}ethoxy)ethoxy]propanamido}butanoic acid (LP28)

(LP28)

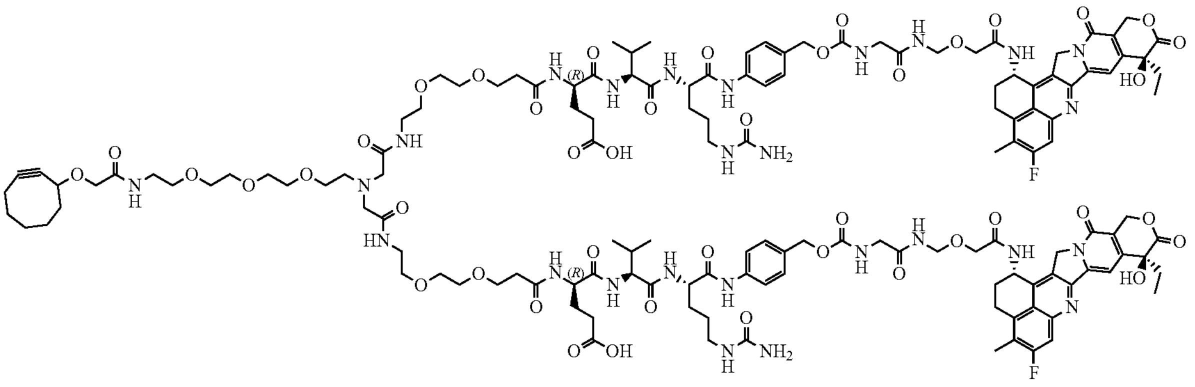

Following the general procedure from LP14 (17 mg, 13 μmol) and intermediate II3b (4.0 mg, 5.0 μmol), branched linker-payload LP28 (TFA salt, 5 mg, 34% yield) was obtained as a white solid after purification by prep-HPLC (10-95% acetonitrile in aq. TFA (0.05%)). ESI m/z: 995.2 $(M/3+H)^+$. $^1$H NMR (400 MHz, $DMSO_{d6}$) δ 9.82 (s, 2H), 8.81 (t, J=6.4 Hz, 2H), 8.52 (d, J=8.8 Hz, 2H), 8.19-8.14 (m, 4H), 8.07 (d, J=8.4 Hz, 2H), 7.78 (d, J=10.8 Hz, 2H), 7.61 (d, J=8.4 Hz, 4H), 7.43 (t, J=5.6 Hz, 2H), 7.31 (s, 2H), 7.27 (d, J=8.4 Hz, 4H), 6.48 (br s, 2H), 6.01 (br s, 2H), 5.63-5.57 (m, 2H), 5.43-5.40 (m, 4H), 5.21-5.16 (m, 4H), 4.93 (s, 4H), 4.63 (d, J=6.4 Hz, 4H), 4.42-4.33 (m, 4H), 4.30-4.25 (m, 2H), 4.24-4.19 (m, 2H), 4.02 (s, 4H), 3.90-3.85 (m, 2H), 3.48-3.73 (m, 2H), 3.69 (br s, 4H), 3.64-3.60 (m, 8H), 3.58-3.55 (m, 6H), 3.52-3.50 (m, 8H), 3.29-3.24 (m, 8H), 3.03-3.00 (m, 2H), 2.97-2.94 (m, 2H), 2.40-2.37 (m, 8H), 2.26-2.15 (m, 14H), 2.09-2.00 (m, 6H), 1.93-1.81 (m, 12H), 1.79-1.70 (m, 8H), 1.66-1.55 (m, 6H), 1.49-1.34 (m, 8H), 0.90-0.81 (m, 20H) ppm. (The protons of COOH and TFA were not revealed) $^{19}$F NMR (376 MHz, DMSO$_{d6}$) δ −71.08, −111.30 ppm.

Example 7L: (4R)-4-[3-(2-{2-[1-(4-{2-Azatricyclo[10.4.0.0$^{4}$, $^{9}$]hexadeca-1(12),4(9),5,7,13,15-hexaen-10-yn-2-yl}-4-oxobutanamido)-12-[({2-[2-(2-{[(1R)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy} methyl)phenyl]carbamoyl}butyl]carbamoyl}-2-methylpropyl]carbamoyl}-3-carboxypropyl]carbamoyl}ethoxy) ethoxy]ethyl}carbamoyl)methyl]-3,6,9-trioxa-12-azatetradecan-14-amido]ethoxy}ethoxy)propanamido]-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl] carbamoyl}methoxy)methyl]carbamoyl}methyl)carbamoyl]oxy}methyl)phenyl]carbamoyl}butyl]carbamoyl}-2-methylpropyl]carbamoyl}butanoic Acid (LP30)

(LP30)
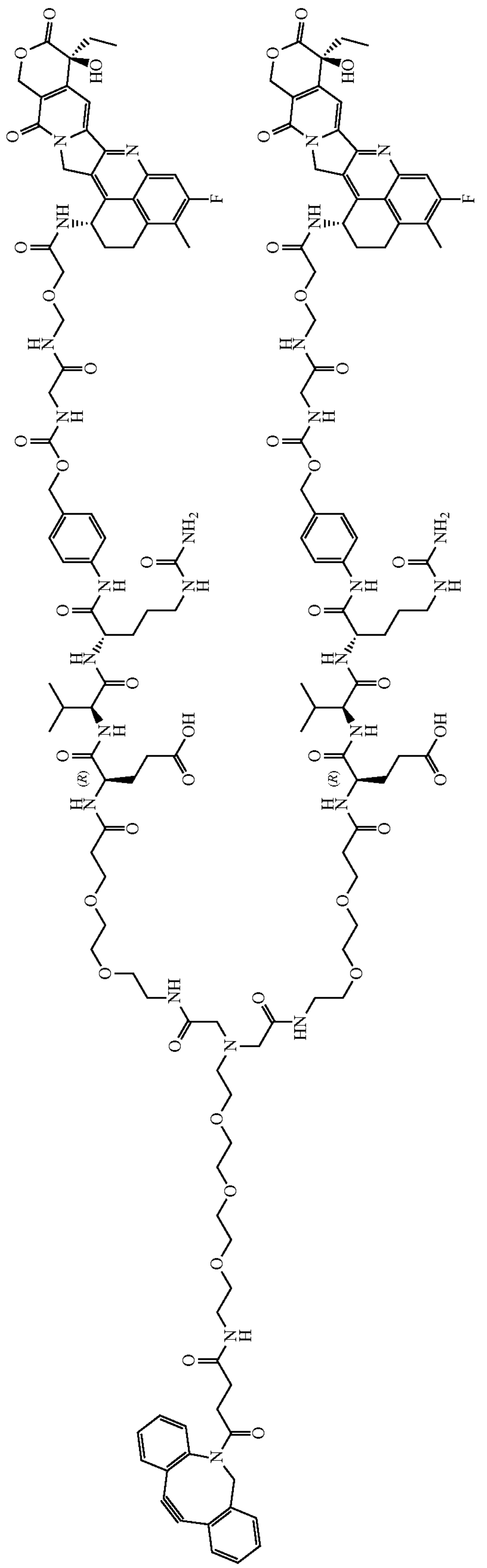

Following the general procedure from LP14 (16 mg, 12 μmol) and intermediate II3c (4.0 mg, 4.3 μmol), branched linker-payload LP30 (5 mg, 37% yield) was obtained as a white solid after purification by prep-HPLC (10-95% acetonitrile in water). ESI m/z: 786.4 $(M/4+H)^+$ (both E-ring-open form, Rt=5.65 min, 34%); 781.8 $(M/4+H)^+$ (mono E-ring-open form, Rt=5.95 min, 43%); 777.3 $(M/4+H)^+$, 1036.2 $(M/3+H)^+$ (lactone form, Rt=6.32 min, 19%).

Example 7M: (4S)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy} methyl) phenyl]carbamoyl}butyl]carbamoyl}-2-methylpropyl]carbamoyl}-4-{3-[2-(2-{12-[({2-[2-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)methyl]-1-({[(9H-fluoren-9-yl)methoxy]carbonyl}amino)-3,6,9-trioxa-12-azatetradecan-14-amido}ethoxy)ethoxy]propanamido}butanoic Acid (LP31f)

(LP31f)

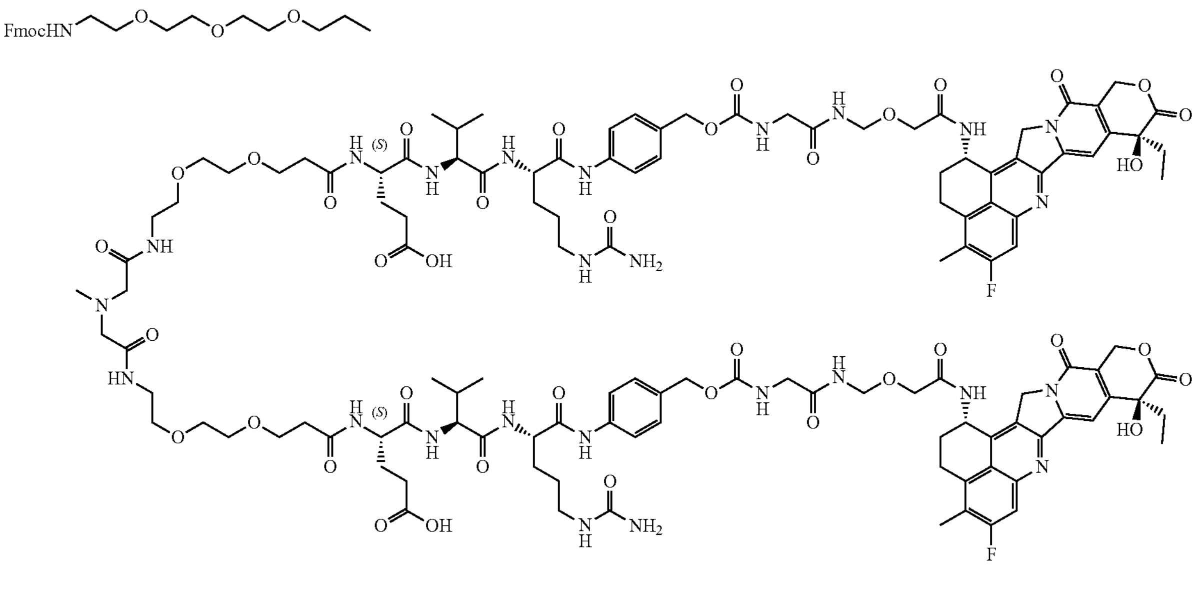

Following the general procedure from LP15 (28 mg, 22 μmol) and intermediate II3f (7.0 mg, 8.8 μmol), compound LP31f (20 mg, 75% yield) was obtained as a white solid after purification by prep-HPLC (10-95% acetonitrile in aq. TFA (0.05%)). ESI m/z: 761.0 $(M/4+H)^+$ (lactone form).

Example 7N: (4S)-4-{3-[2-(2-{1-Amino-12-[({2-[2-(2-{[(1S)-1-{[(1S)-1-{[(1S)-4- (carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl] carbamoyl}methyl) carbamoyl]oxy}methyl)phenyl] carbamoyl}butyl]carbamoyl}-2-methylpropyl] carbamoyl}-3-carboxypropyl]carbamoyl}ethoxy) ethoxy]ethyl}carbamoyl)methyl]-3,6,9-trioxa-12-azatetradecan-14-amido}ethoxy)ethoxy] propanamido}-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl] carbamoyl}methyl)carbamoyl]oxy}methyl)phenyl] carbamoyl}butyl]carbamoyl}-2-methylpropyl] carbamoyl}butanoic Acid (LP31)

(LP31)

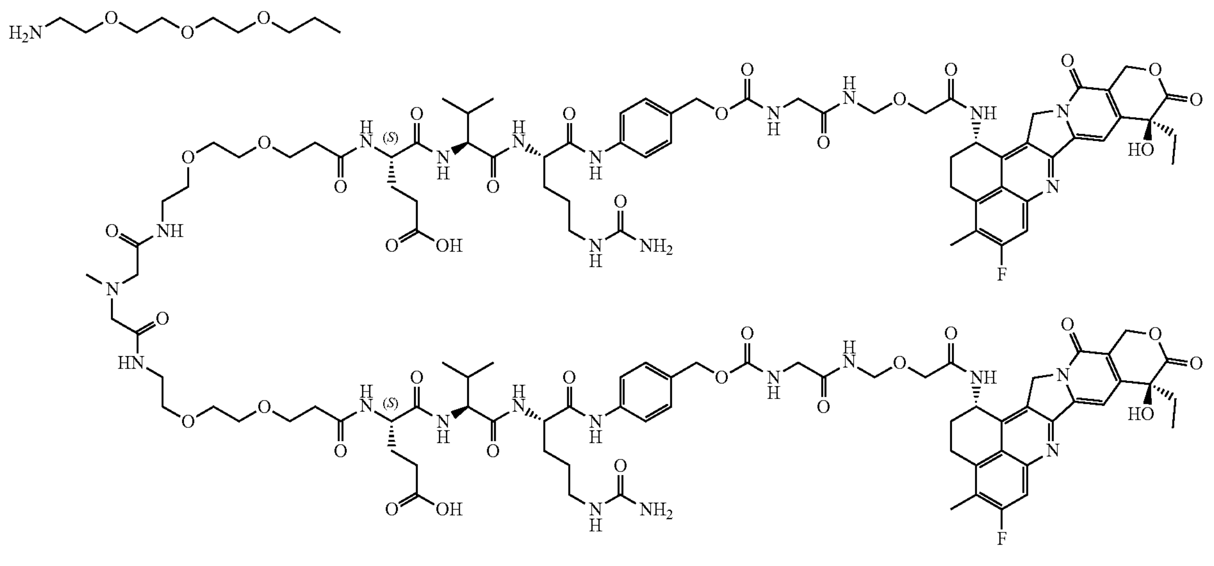

To a solution of compound LP31f (20 mg, 6.6 μmol) in DMF (2 mL) was added piperidine (6.0 mg, 66 μmol), and the reaction mixture was stirred at room temperature for an hour until Fmoc was totally removed according to LCMS. The mixture was directly purified by prep-HPLC (10-95% acetonitrile in aq. TFA (0.05%)) to give LP31 (TFA salt, 13 mg, 70% yield) as a white solid. ESI: 940.5 $(M/3+H)^+$. $^1$H NMR (400 MHz, DMSO$_{d6}$) δ 10.05 (br s, 2H), 8.80 (t, J=7.2 Hz, 2H), 8.51 (d, J=8.8 Hz, 2H), 8.19 (d, J=7.2 Hz, 2H), 8.09 (d, J=8.4 Hz, 2H), 7.80-7.75 (m, 7H), 7.58 (d, J=8.4 Hz, 4H), 7.42 (t, J=5.6 Hz, 2H), 7.31 (s, 2H), 7.27 (d, J=8.8 Hz, 4H), 7.12-6.98 (s, 1H), 6.53 (br s, 2H), 6.04-6.58 (m, 2H), 5.62-5.57 (m, 2H), 5.46-5.40 (m, 6H), 5.21-5.16 (m, 4H), 4.92 (s, 4H), 4.62 (d, J=6.4 Hz, 4H), 4.40-4.32 (m, 4H), 4.19 (d, J=7.6 Hz, 2H), 4.01 (s, 4H), 3.63-3.55 (m, 18H), 3.50-3.46 (m, 10H), 3.27-3.26 (m, 2H), 3.02-2.92 (m, 8H), 2.45-2.31 (m, 16H), 2.26-2.15 (m, 10H), 2.00-1.95 (m, 2H), 1.91-1.80 (m, 8H), 1.73-1.66 (m, 4H), 1.61-1.56 (m, 2H), 1.46-1.31 (m, 6H), 0.89-0.80 (m, 22H) ppm. (Protons of COOH and TFA were not revealed.) $^{19}$F NMR (376 MHz, DMSO$_{d6}$) δ −73.74, −111.29 ppm.

Example 7O: (4S)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}-4-{3-[2-(2-{12-[({2-[2-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl methoxy)methyl]carbamoyl}methyl)carbamoyl]oxy}methyl)phenyl]carbamoyl}butyl]carbamoyl}-2-methyl propyl]carbamoyl}-3-carboxypropyl]carbamoyl}ethoxy)ethoxy]ethyl}carbamoyl)methyl]-1-[2-(cyclooct-2-yn-1-yloxy)acetamido]-3,6,9-trioxa-12-azatetradecan-14-amido}ethoxy)ethoxy]propanamido}butanoic Acid (LP32)

(LP32)

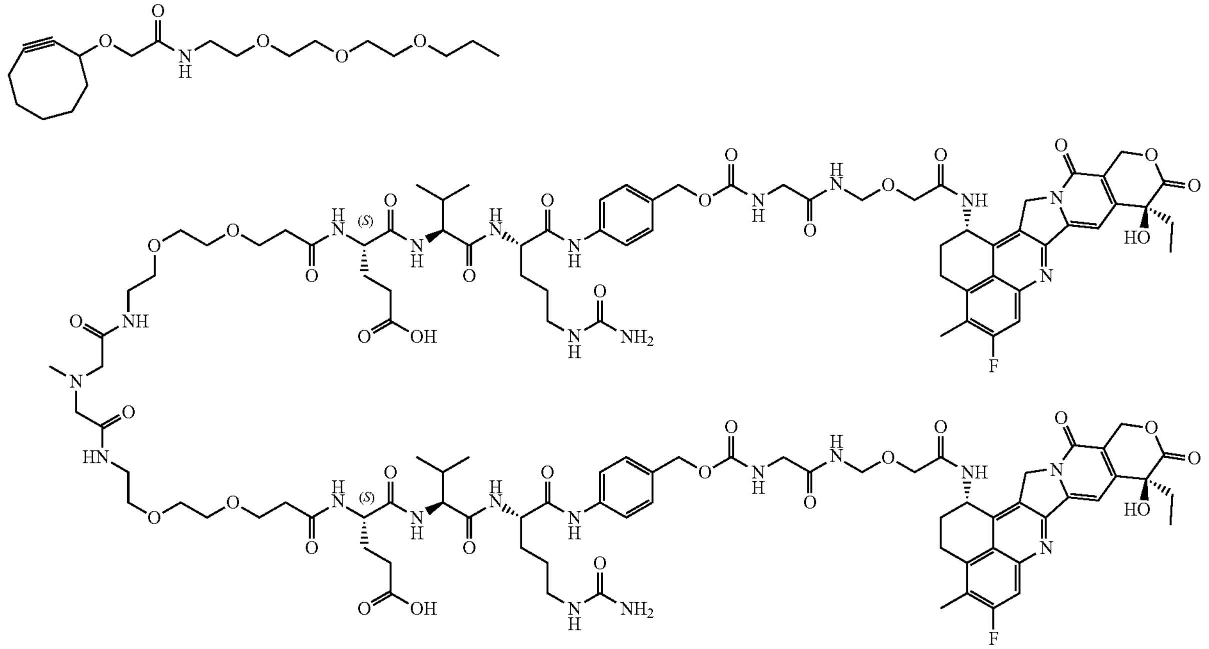

Following the general procedure starting from II3b (5.0 mg, 6.9 μmol) and LP15 (22 mg, 17 μmol), linker-payload LP32 (12 mg, 62% yield) was obtained as a white solid after purification by prep-HPLC (10-95% acetonitrile in aq. formic acid (0.05%)). ESI m/z: 995.5 (M/3+H)$^+$. $^1$H NMR (400 MHz, DMSO$_{d6}$) δ 10.04 (br s, 2H), 8.80 (t, J=6.4 Hz, 2H), 8.51 (d, J=9.2 Hz, 2H), 8.19 (d, J=7.2 Hz, 2H), 8.09 (d, J=8.0 Hz, 2H), 8.02 (t, J=6.0 Hz, 2H), 7.80-7.75 (m, 4H), 7.58 (d, J=8.4 Hz, 4H), 7.43 (d, J=6.0 Hz, 2H), 7.31 (s, 2H), 7.27 (d, J=8.0 Hz, 4H), 6.53 (s, 2H), 6.01 (br s, 2H), 5.62-5.57 (m, 2H), 5.46-5.40 (m, 8H), 5.19 (s, 4H), 4.92 (s, 4H), 4.62 (d, J=6.4 Hz, 4H), 4.40-4.32 (m, 4H), 4.29-4.25 (s, 1H), 4.19 (d, J=7.2 Hz, 2H), 4.01 (s, 4H), 3.89-3.84 (m, 1H), 3.78-3.73 (m, 1H), 3.63-3.57 (m, 8H), 3.51-3.45 (s, 22H), 3.27-3.22 (m, 10H), 3.16 (s, 4H), 3.05-3.00 (m, 3H), 2.96-2.92 (m, 2H), 2.68-2.64 (m, 2H), 2.38 (s, 8H), 2.24-2.15 (m, 10H), 1.97-1.90 (m, 4H), 1.86-1.81 (m, 6H), 1.72-1.67 (m, 4H), 1.61-1.55 (m, 4H), 1.45-1.35 (m, 6H), 1.25-1.21 (m, 2H), 0.89-0.81 (m, 22H) ppm. (protons of COOH were not revealed) $^{19}$F NMR (376 MHz, DMSO$_{d6}$) δ -111.29 ppm.

Example 7P: (4S)-4-[3-(2-{2-[1-(4-{2-Azatricyclo[10.4.0.0$^{4}$, $^{9}$]hexadeca-1(12),4(9),5,7,13,15-hexaen-10-yn-2-yl}-4-oxobutanamido)-12-[({2-[2-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)methyl]-3,6,9-trioxa-12-azatetradecan-14-amido]ethoxy}ethoxy)propanamido]-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}butanoic Acid (LP34)

(LP34)

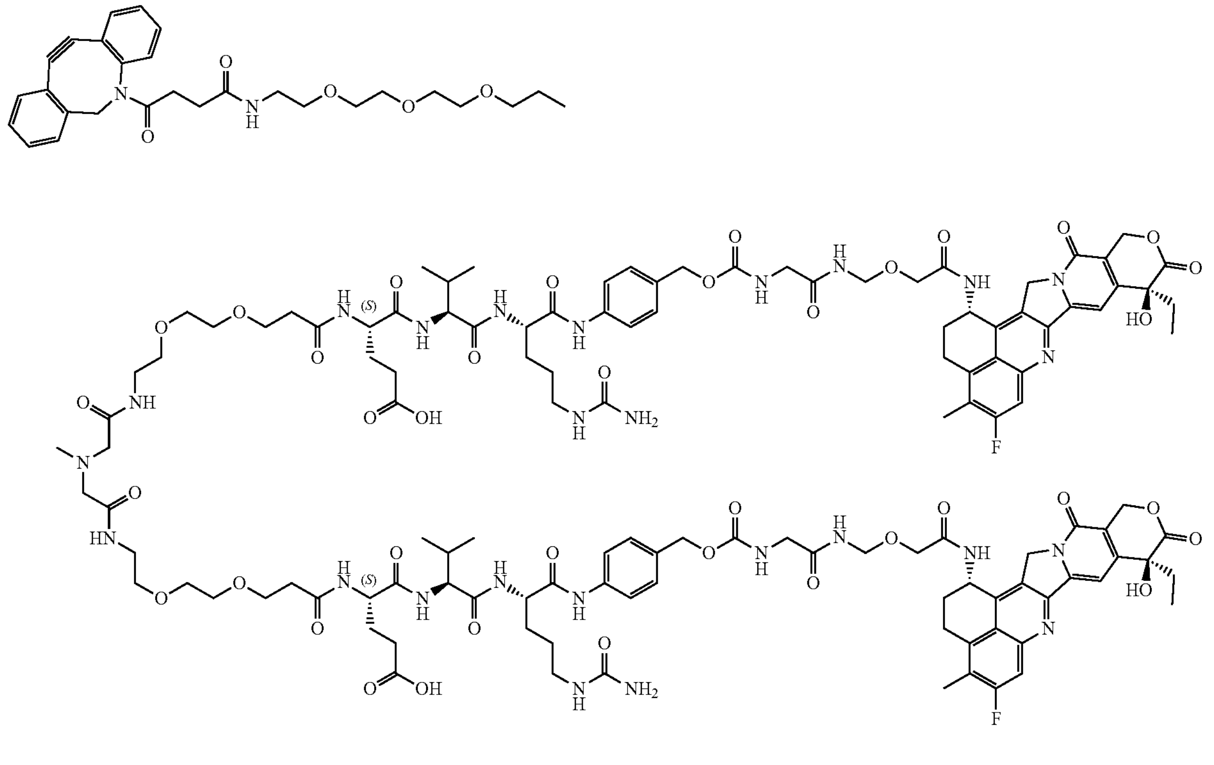

Following the general procedure starting from 113c (2.8 mg, 3 μmol) and LP15 (12 mg, 9 μmol), linker-payload LP34 (4 mg, 43% yield) was obtained as a white solid after purification by prep-HPLC (10-95% acetonitrile in aq. formic acid (0.05%)) and LP15 (3 mg) was recovered. ESI m/z: 629.3 (M/5+H)$^{+}$, 786.5 (M/4+H)$^{+}$ (both E-ring-open form, Rt=5.70 min, 4%); 1042.2 (M/3+H)$^{+}$, 781.8 (M/4+H)$^{+}$ (mono E-ring-open form, Rt=5.98 min, 28%); 1036.1 (M/3+H)$^{+}$, 777.4 (M/4+H)$^{+}$ (Rt=6.33 min, 65%). $^{1}$H NMR (400 MHz, DMSO$_{d6}$) δ 10.04 (s, 2H), 8.80 (t, J=6.4 Hz, 2H), 8.50 (d, J=8.0 Hz, 2H), 8.18 (d, J=9.6 Hz, 2H), 8.08 (d, J=8.0 Hz, 2H), 8.00 (d, J=5.6 Hz, 2H), 7.80-7.74 (m, 4H), 7.67 (d, J=8.4 Hz, 1H), 7.62-7.57 (m, 4H), 7.50-7.41 (m, 6H), 7.37-7.26 (m, 10H), 6.53 (s, 2H), 5.98 (t, J=5.6 Hz, 2H), 5.64-5.57 (m, 2H), 5.44-5.41 (m, 7H), 5.20 (s, 4H), 5.02 (d, J=14.4 Hz, 1H), 4.92 (s, 4H), 4.63 (d, J=6.0 Hz, 4H), 4.41-4.32 (m, 4H), 4.21-4.17 (m, 2H), 4.02 (s, 4H), 3.62-3.58 (m, 8H), 3.58-3.46 (m, 16H), 3.26-3.22 (m, 6H), 3.19-3.15 (m, 4H), 3.11-3.00 (m, 4H), 2.96-2.91 (m, 2H), 2.67-2.61 (m, 2H), 2.41-2.38 (m, 11H), 2.25-2.13 (m, 13H), 2.03-1.93 (m, 4H), 1.88-1.78 (m, 8H), 1.74-1.53 (m, 10H), 1.48-1.32 (m, 6H), 0.88-0.81 (m, 18H) ppm. (Protons of COOH were not revealed.)

Example 7Q: (4R)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}-4-(3-{2-[2-(3-{3-[2-({2-[2-(2-{[(1R)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)ethoxy]-2-[2-(cyclooct-2-yn-1-yloxy)acetamido]propoxy}propanamido)ethoxy]ethoxy}propanamido)butanoic acid (LP36)

(LP36)

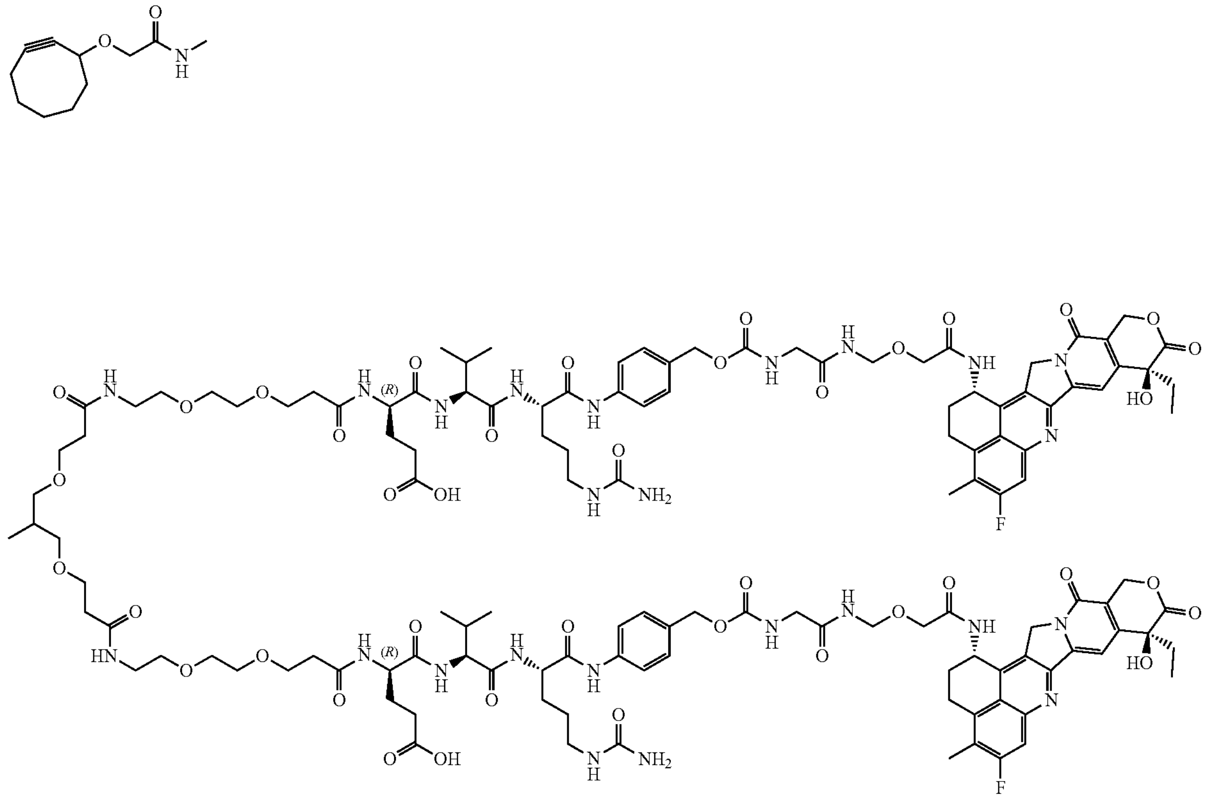

Following the general procedure starting from II4b (3.0 mg, 4.1 μmol) and LP14 (13 mg, 10 μmol), linker-payload LP36 (TFA salt, 5 mg, 38% yield) was obtained as a white solid after purification by prep-HPLC (10-95% acetonitrile in aq. TFA (0.05%)). ESI m/z: 970.8 $(M/3+H)^+$. $^{1}$H NMR (400 MHz, DMSO$_{d6}$) δ 12.07 (br s, 2H), 9.80 (s, 2H), 8.81 (t, J=6.4 Hz, 2H), 8.51 (d, J=8.8 Hz, 2H), 8.16 (t, J=6.8 Hz, 4H), 8.08 (d, J=7.6 Hz, 2H), 7.93 (d, J=5.2 Hz, 2H), 7.78 (d, J=10.8 Hz, 2H), 7.63-7.59 (m, 4H), 7.44 (t, J=5.6 Hz, 2H), 7.36 (d, J=8.4 Hz, 1H), 7.30 (s, 2H), 7.27 (d, J=8.4 Hz, 4H), 6.54 (s, 2H), 6.00 (t, J=5.6 Hz, 2H), 5.63-5.57 (m, 2H), 5.46-5.40 (m, 8H), 5.19 (m, 4H), 4.92 (s, 4H), 4.63 (d, J=6.4 Hz, 4H), 4.41-4.32 (m, 4H), 4.29-4.25 (m, 1H), 4.23-4.19 (m, 2H), 4.01 (s, 4H), 3.90-3.85 (m, 1H), 3.79-3.74 (m, 1H), 3.63-3.60 (m, 4H), 3.59-3.55 (m, 6H), 3.52-3.49 (m, 2H), 3.46-3.42 (m, 8H), 3.21-3.16 (m, 6H), 3.05-2.89 (m, 6H), 2.40-2.36 (m, 8H), 2.33-2.28 (m, 6H), 2.26-2.13 (m, 12H), 2.09-2.01 (m, 4H), 1.92-1.80 (m, 8H), 1.79-1.70 (m, 6H), 1.64-1.55 (m, 4H), 1.46-1.34 (m, 6H), 0.89-0.81 (m, 23H) ppm. (protons of TFA were not revealed) $^{19}$F NMR (376 MHz, DMSO$_{d6}$) δ −75, −111 ppm.

Example 7R: (4S)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}-4-(3-{2-[2-(3-{3-[2-({2-[2-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)ethoxy]-2-[2-(cyclooct-2-yn-1-yloxy)acetamido]propoxy}propanamido)ethoxy]ethoxy}propanamido)butanoic acid (LP37)

(LP37)

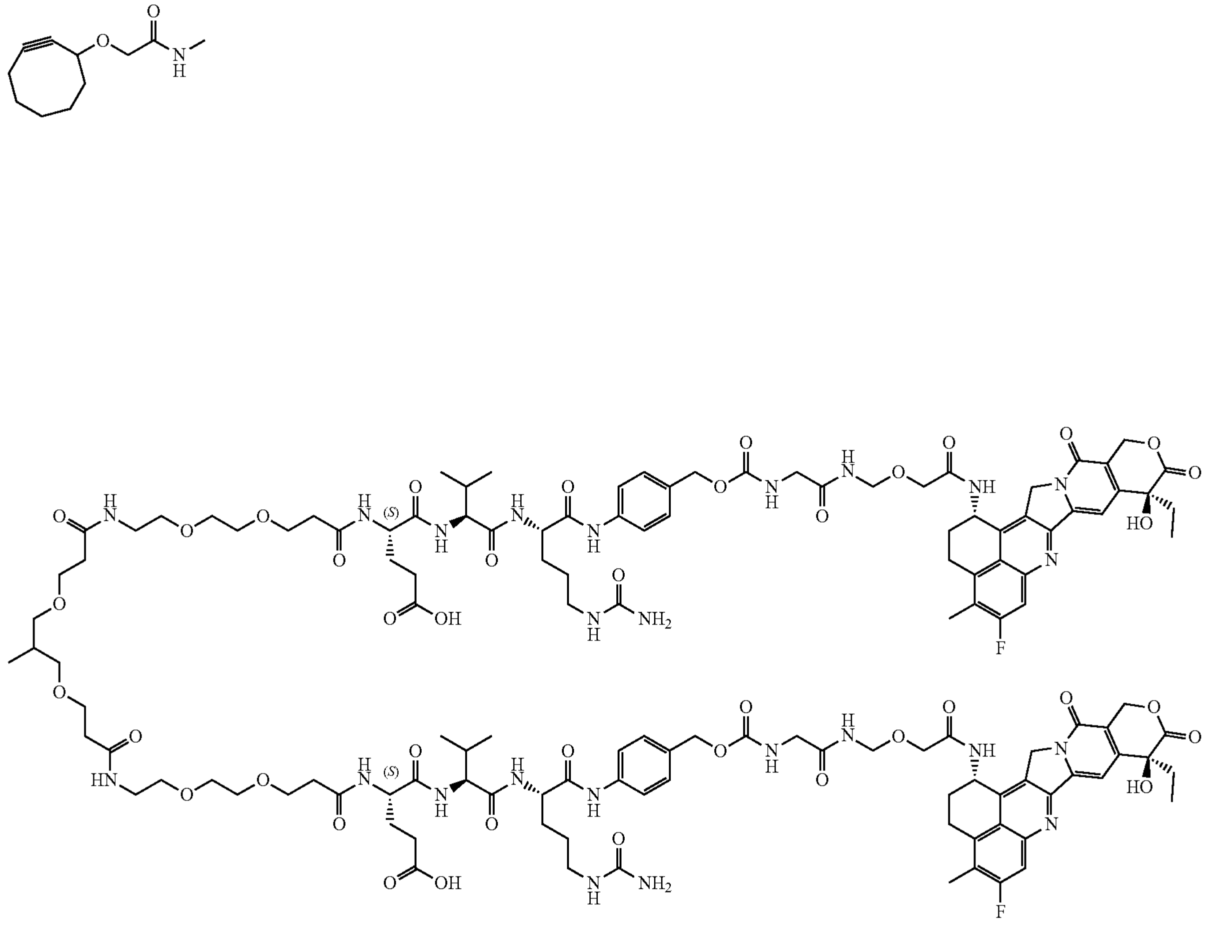

Following the general procedure starting from II4b (3.0 mg, 4.1 μmol) and LP15 (13 mg, 10 μmol), linker-payload LP37 (TFA salt, 4 mg, 31% yield) was obtained as a white solid after purification by prep-HPLC (10-95% acetonitrile in aq. TFA (0.05%)). ESI m/z: 970.6 (M/3+H)$^{+}$.

Example 7S: (4S)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0[2], [14].0[4], [13].0[6], [11].0[20], [24]]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}-4-(3-{2-[2-(3-{3-[2-({2-[2-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0[2], [14].0[4], [13].0[6], [11].0[20], [24]]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)ethoxy]-2-[3-(2-{2-[2-(cyclooct-2-yn-1-yloxy)acetamido]ethoxy}ethoxy)propanamido]propoxy}propanamido)ethoxy]ethoxy}propanamido)butanoic acid (LP38)

(LP38)

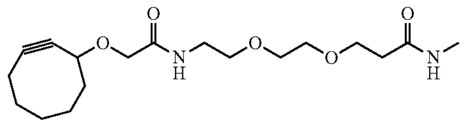

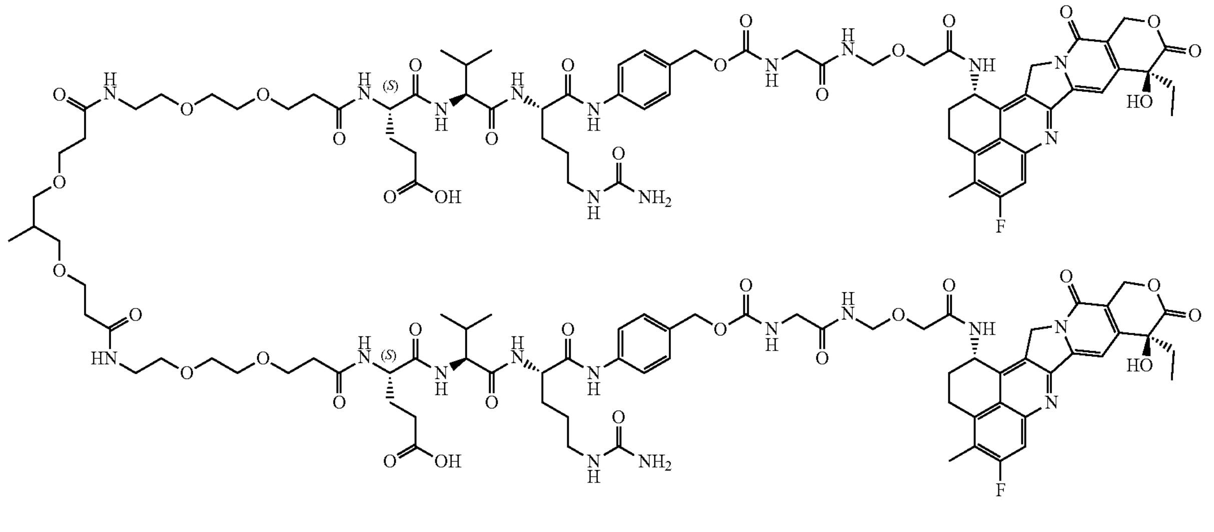

Following the general procedure starting from II4Ab (6.0 mg, 6.9 μmol) and LP15 (22 mg, 17 μmol), linker-payload LP38 (6.5 mg, 31% yield) was obtained as a white solid after purification by prep-HPLC (10-95% acetonitrile in aq. formic acid (0.05%)). ESI m/z: 1024.3 $(M/3+H)^+$. $^1H$ NMR (400 MHZ, $DMSO_{d6}$) δ 10.04 (s, 2H), 8.80 (t, J=6.4 Hz, 2H), 8.51 (d, J=8.4 Hz, 2H), 8.19 (d, J=6.0 Hz, 2H), 8.09 (d, J=7.6 Hz, 2H), 7.93 (t, J=4.8 Hz, 2H), 7.79 (s, 1H), 7.78-7.73 (m, 4H), 7.64-7.61 (m, 1H), 7.58 (d, J=8.4 Hz, 4H), 7.43 (d, J=5.6 Hz, 2H), 7.31 (s, 2H), 7.27 (d, J=8.4 Hz, 4H), 6.53 (s, 2H), 6.01 (br s, 2H), 5.62-5.57 (m, 2H), 5.46-5.40 (m, 8H), 5.19 (s, 4H), 4.92 (s, 4H), 4.62 (d, J=6.4 Hz, 4H), 4.40-4.32 (m, 4H), 4.29-4.25 (m, 1H), 4.19 (d, J=7.6 Hz, 2H), 4.01 (s, 4H), 3.89-3.84 (m, 1H), 3.78-3.73 (m, 1H), 3.63-3.55 (m, 17H), 3.47 (s, 12H), 3.27-3.23 (m, 4H), 3.21-3.17 (m, 6H), 3.04-3.00 (m, 2H), 2.96-2.92 (m, 2H), 2.38 (s, 8H), 2.36-2.29 (m, 10H), 2.25-2.14 (m, 12H), 1.99-1.94 (m, 2H), 1.90-1.81 (m, 8H), 1.76-1.67 (m, 6H), 1.61-1.55 (m, 4H), 1.46-1.35 (m, 6H), 0.89-0.81 (m, 22H) ppm. (protons of COOH were not revealed) $^{19}F$ NMR (376 MHZ, $DMSO_{d6}$) δ −111 ppm.

Example 7T: (4S)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}-4-(3-{2-[2-(3-{3-[2-({2-[2-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)ethoxy]-2-{[2-({2-[2-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)ethoxy]ethyl}carbamoyl)ethoxy]methyl}-2-[3-(2-{2-[2-(cyclooct-2-yn-1-yloxy)acetamido]ethoxy}ethoxy)propanamido]propoxy}propanamido)ethoxy]ethoxy}propanamido)butanoic Acid (LP41)

(LP41)

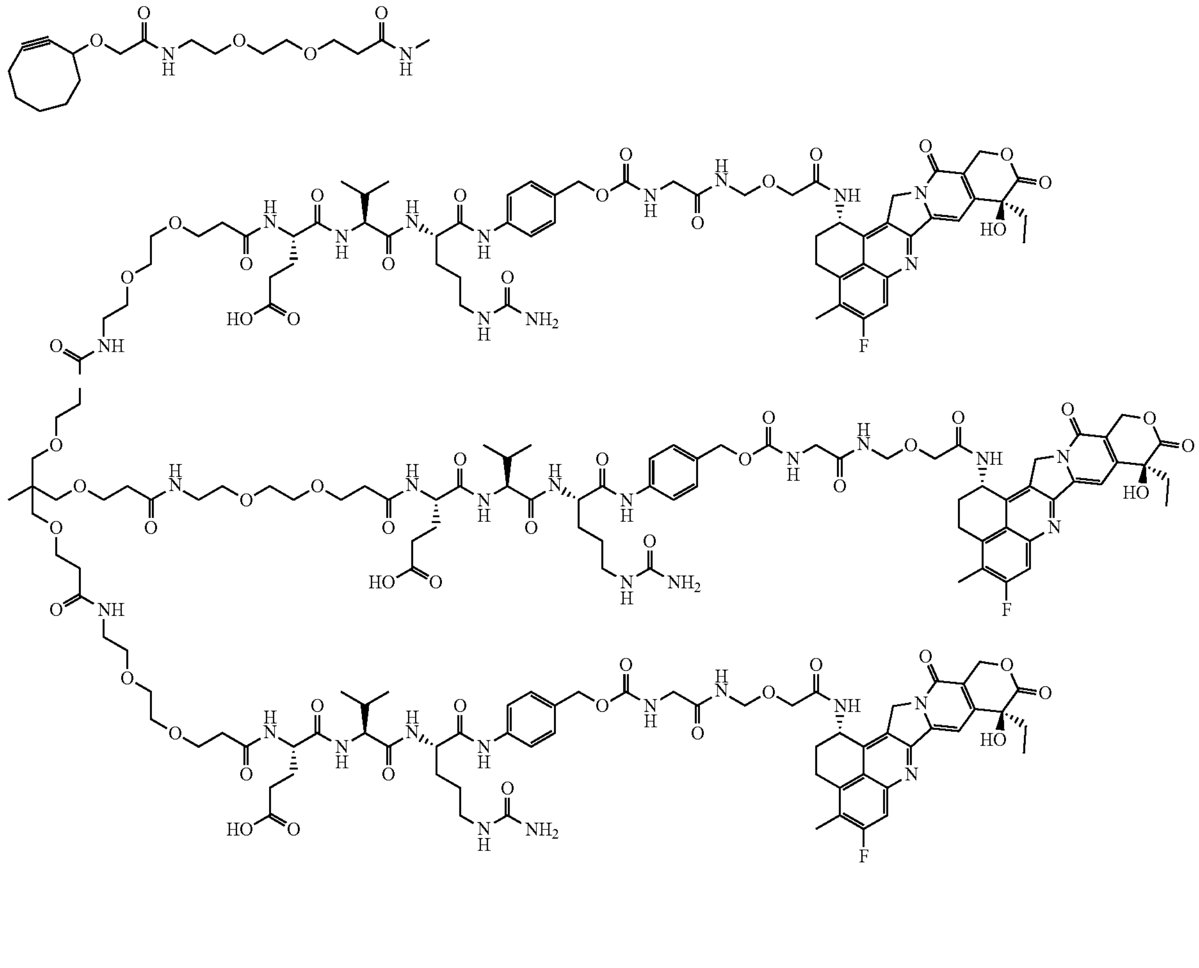

Following the general procedure starting from II5Ab (5.0 mg, 4.8 μmol) and LP15 (24 mg, 19 μmol, 4 equiv.), linker-payload LP41 (7.1 mg, 33% yield) was obtained as a white solid after purification by prep-HPLC (10-95% acetonitrile in aq. formic acid (0.1%)). ESI m/z: 1107.6 $(M/4+H)^+$. 1H NMR (400 MHz, $DMSO_{d6}$) δ 10.04 (br s, 3H), 8.80 (t, J=6.8 Hz, 3H), 8.50 (d, J=8.8 Hz, 3H), 8.20 (d, J=6.4 Hz, 3H), 8.09 (d, J=7.6 Hz, 3H), 7.94-7.90 (m, 3H), 7.77 (d, J=10.8 Hz, 6H), 7.58 (d, J=8.4 Hz, 6H), 7.42 (d, J=6.4 Hz, 3H), 7.30 (s, 3H), 7.27 (d, J=8.4 Hz, 6H), 6.52 (s, 3H), 6.01 (br s, 3H), 5.62-5.57 (m, 3H), 5.46-5.40 (m, 13H), 5.20-5.16 (m, 6H), 4.92 (s, 6H), 4.62 (d, J=6.0 Hz, 6H), 4.40-4.32 (m, 6H), 4.19 (t, J=7.6 Hz, 3H), 4.01 (s, 6H), 3.89-3.84 (m, 1H), 3.78-3.73 (m, 1H), 3.64-3.51 (m, 30H), 3.47 (s, 15H), 3.40-3.36 (m, 9H), 3.26-3.24 (m, 3H), 3.21-3.17 (m, 9H), 3.03-3.00 (m, 3H), 2.96-2.91 (m, 3H), 2.43-2.41 (m, 3H), 2.38 (s, 9H), 2.36-2.28 (m, 15H), 2.25-2.20 (m, 9H), 2.18-2.14 (m, 6H), 1.98-1.94 (m, 3H), 1.87-1.81 (m, 9H), 1.74-1.70 (m, 3H), 1.60-1.56 (m, 3H), 1.43-1.35 (m, 6H), 0.88-0.79 (m, 33H) ppm. (protons of COOH were not revealed) $^{19}F$ NMR (376 MHz, $DMSO_{d6}$) δ −111 ppm.

Scheme 11. Synthesis of LP39
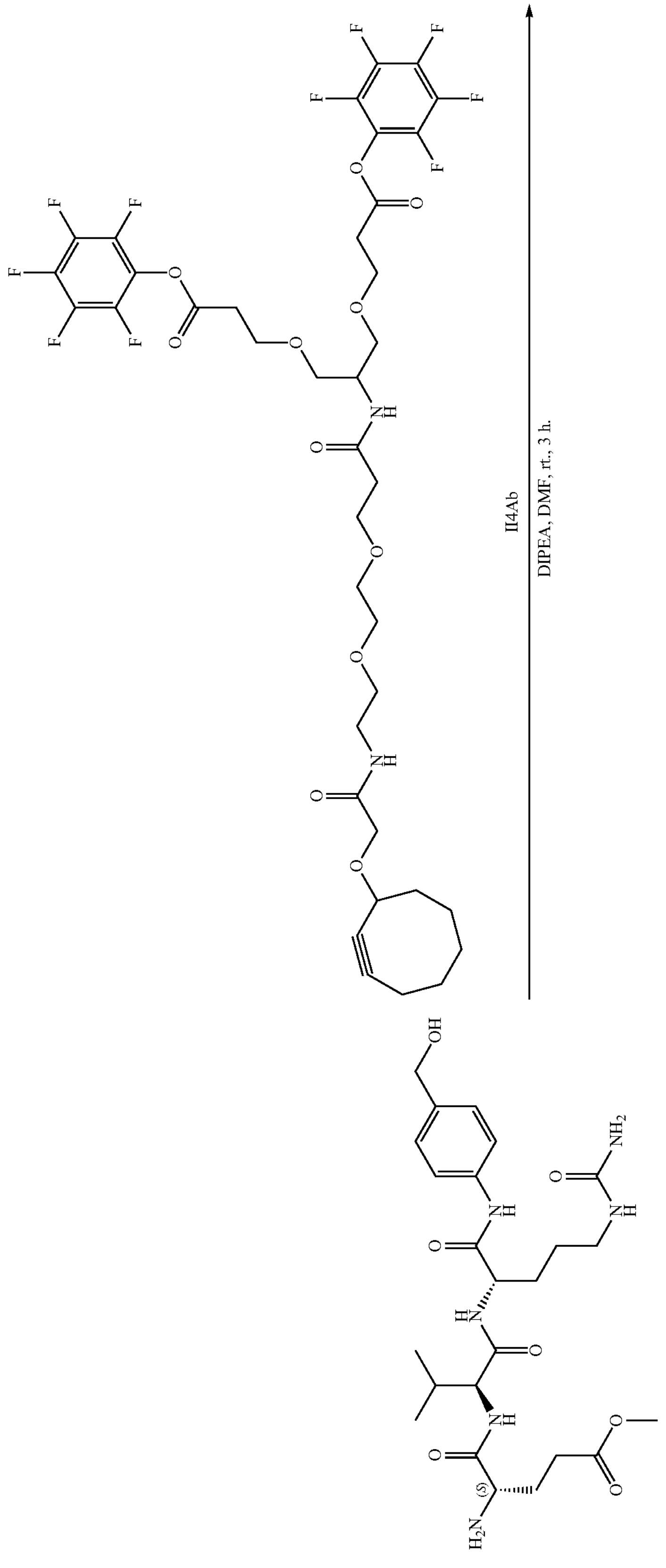
$^{L}$EvcPAB

-continued
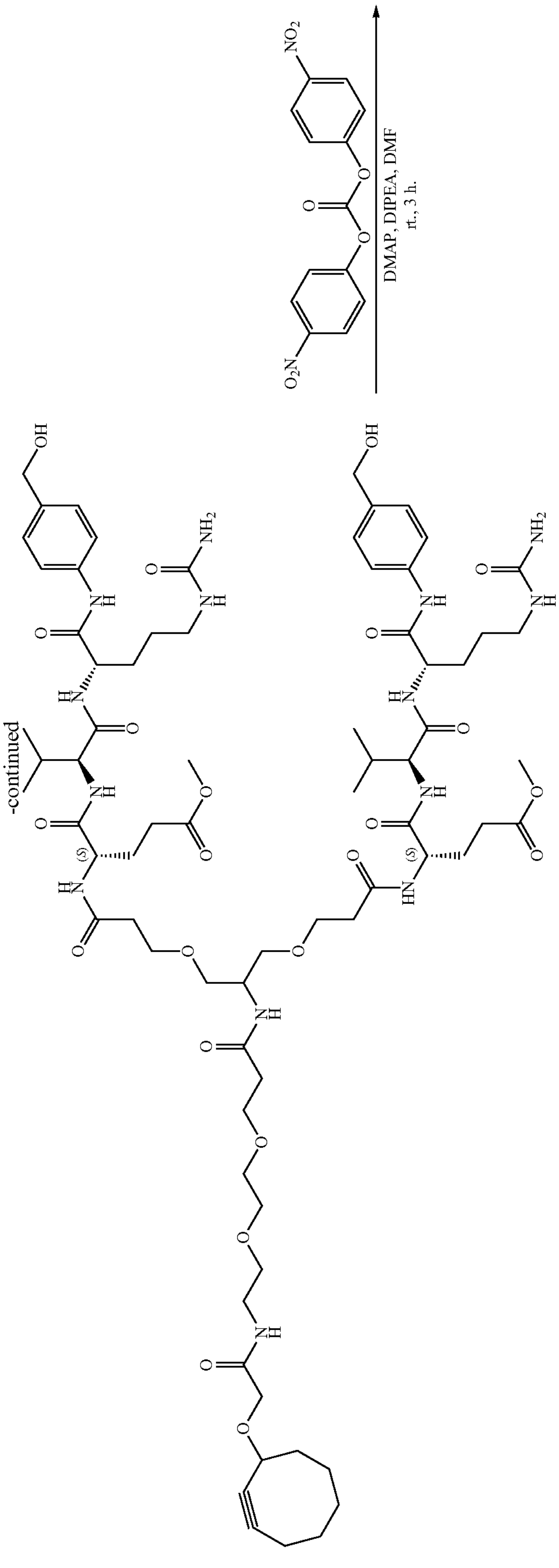
LP39-1

-continued
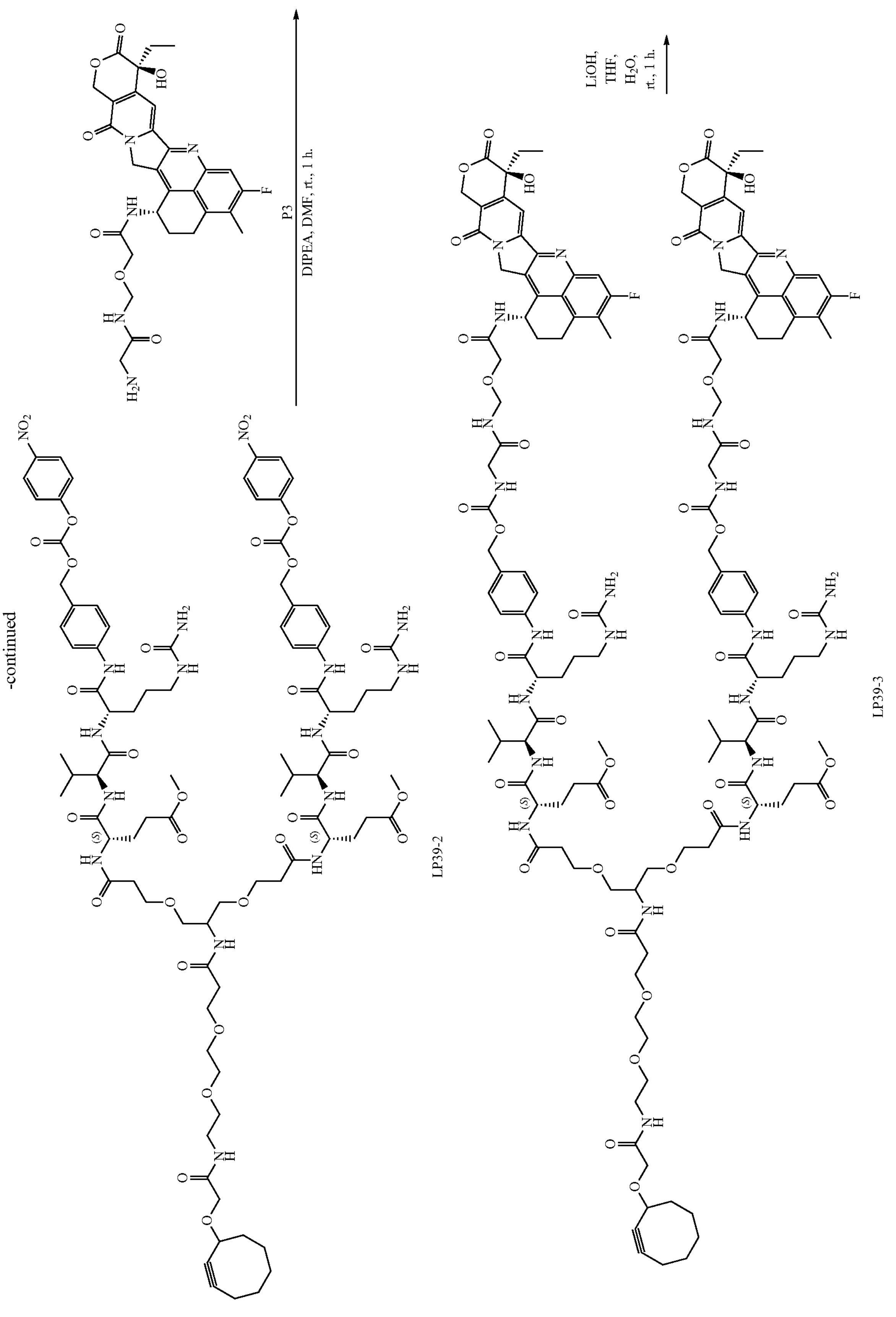
LP39-2
LP39-3

-continued
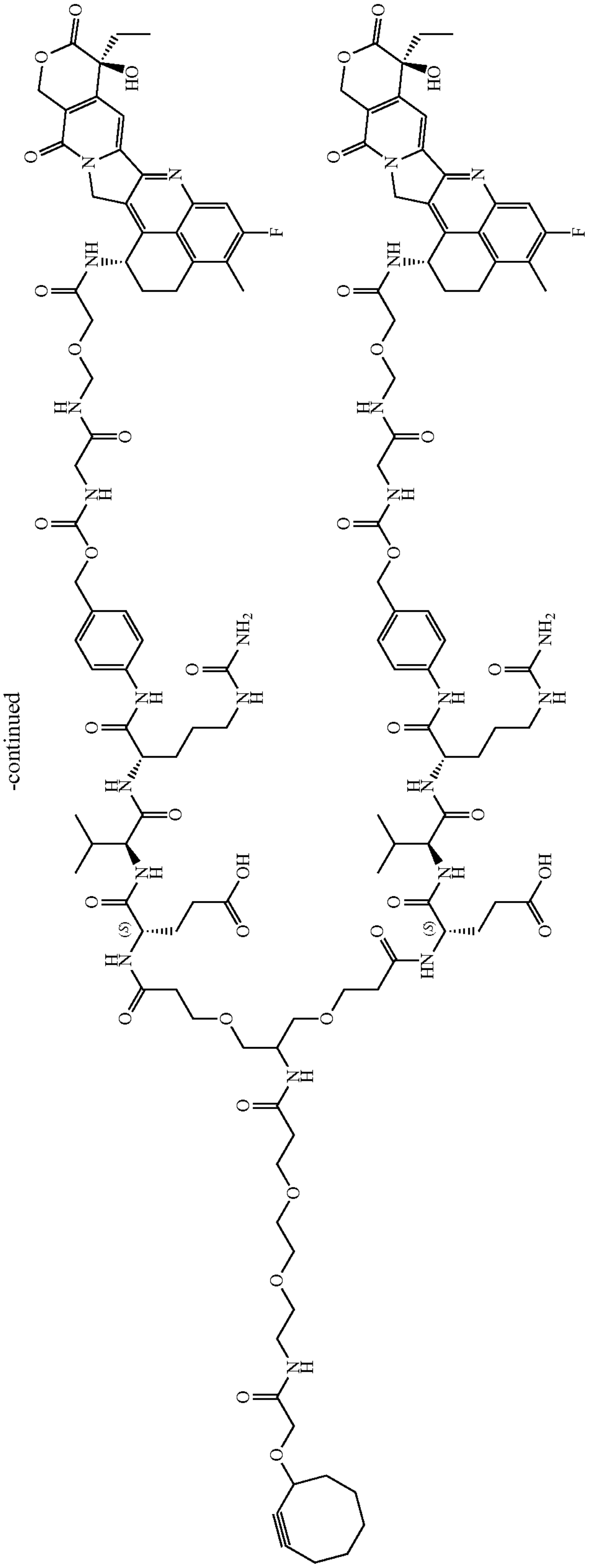
LP39

Example 7U: Methyl (4S)-4-{[(1S)-1-{[(1S)-4-(Carbamoylamino)-1-{[4-(hydroxymethyl)phenyl]carbamoyl}butyl]carbamoyl}-2-methylpropyl]carbamoyl}-4-{3-[3-(2-{[(1S)-1-{[(1S)-1-{[(1S)-4-(carbamoylamino)-1-{[4-(hydroxymethyl)phenyl]carbamoyl}butyl]carbamoyl}-2-methylpropyl]carbamoyl}-4-methoxy-4-oxobutyl]carbamoyl}ethoxy)-2-[3-(2-{2-[2-(cyclooct-2-yn-1-yloxy)acetamido]ethoxy}ethoxy)propanamido]propoxy]propanamido}butanoate (LP39-1)

(LP39-1)

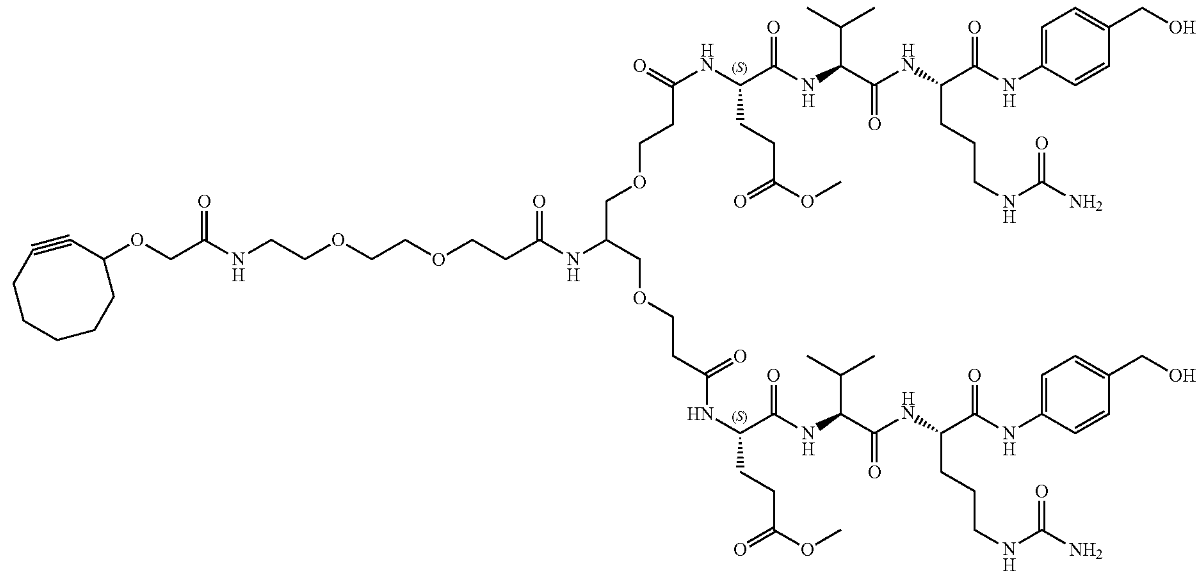

To a solution of compound II4Ab (0.13 g, 0.15 mmol) in DMF (3 mL) were added DIPEA (58 mg, 0.45 mmol) and $^{L}$EvcPAB (78 mg, 0.15 mmol), and the reaction mixture was stirred at room temperature for 3 hours, which was monitored by LCMS. The resulting mixture was purified by reversed phase flash chromatography (0-65% acetonitrile in aq. TFA (0.01%)) to give compound LP39-1 as a white solid. ESI m/z: 784.5 $(M/2+H)^{+}$.

Example 7V: Methyl (4S)-4-{[(1S)-1-{[(1S)-4-(carbamoylamino)-1-{[4-({[(4-nitrophenoxy) carbonyl] oxy}methyl)phenyl]carbamoyl}butyl]carbamoyl}-2-methylpropyl]carbamoyl}-4-{3-[3-(2-{[(1S)-1-{[(1S)-1-{[(1S)-4-(carbamoylamino)-1-{[4-({[(4-nitrophenoxy)carbonyl]oxy}methyl)phenyl]carbamoyl}butyl]carbamoyl}-2-methylpropyl]carbamoyl}-4-methoxy-4-oxobutyl]carbamoyl}ethoxy)-2-[3-(2-{2-[2-(cyclooct-2-yn-1-yloxy) acetamido] ethoxy}ethoxy)propanamido]propoxy] propanamido}butanoate (LP39-2)

(LP39-2)

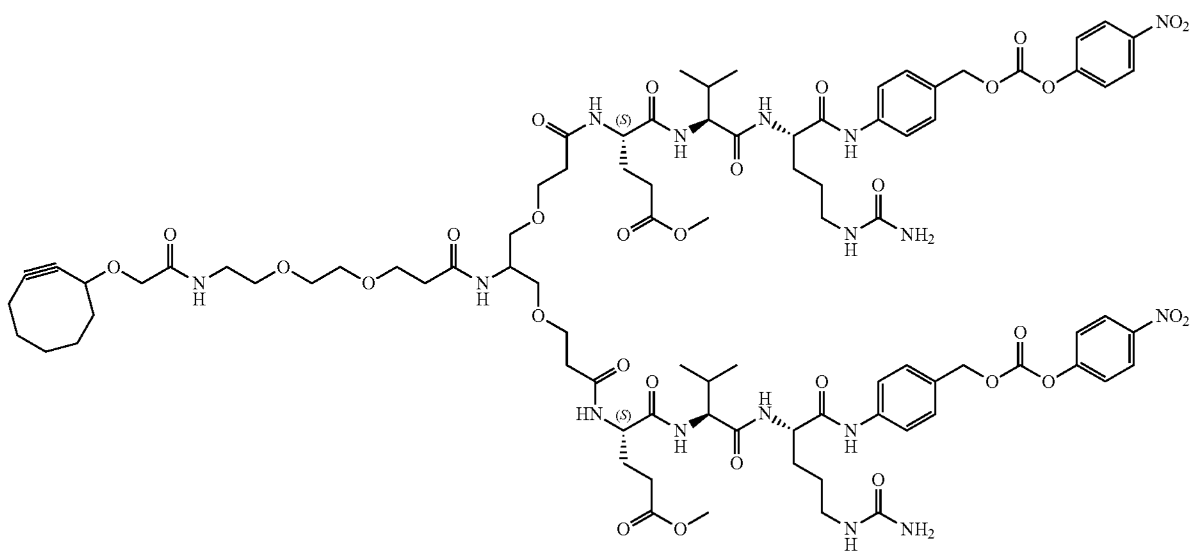

To a solution of compound LP39-1 (0.15 g, 92 μmol) in DMF (5 mL) were added DMAP (11 mg, 92 μmol), DIPEA (36 mg, 0.28 mmol) and bis(4-nitrophenyl) carbonate (85 mg, 0.28 mmol), and the reaction mixture was stirred at room temperature for 3 hours, which was monitored by LCMS. The resulting mixture was directly separated by reversed phase flash chromatography (0-65% acetonitrile in water) to give compound LP39-2 (0.10 g, 57% yield) as a white solid. ESI m/z: 950.0 $(M/2+H)^+$.

Example 7W: Methyl (4S)-4-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.$0^2$, $^{14}.0^4$, $^{13}.0^6$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}-4-{3-[3-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.$0^2$, $^{14}.0^4$, $^{13}.0^6$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-4-methoxy-4-oxobutyl]carbamoyl}ethoxy)-2-[3-(2-{2-[2-(cyclooct-2-yn-1-yloxy) acetamido]ethoxy}ethoxy)propanamido]propoxy]propanamido}butanoate (LP39-3)

(LP39-3)

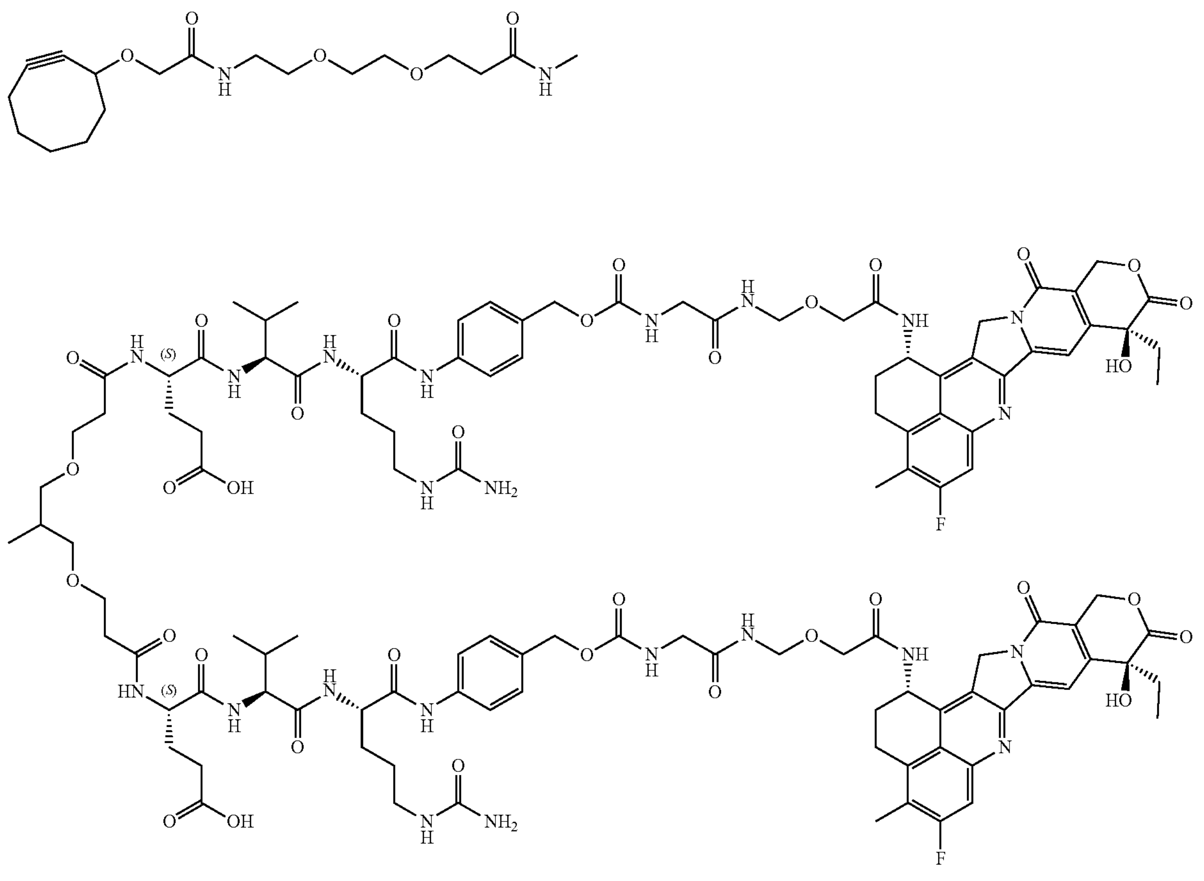

To a solution of compound LP39-2 (65 mg, 34 μmol) in DMF (3 mL) were added DIPEA (22 mg, 0.17 mmol) and payload P3 (50 mg, 86 μmol), and the reaction mixture was stirred at room temperature for an hour, which was monitored by LCMS. The resulting mixture was purified by reversed phase flash chromatography (0-65% acetonitrile in aq. TFA (0.01%)) to give compound LP39-3 (44 mg, 85% yield) as a white solid. ESI m/z: 927.2 $(M/3+H)^+$.

Example 7X: (4S)-4-{[(1S)-1-{[(1S)-4-(Carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.$0^{2}$, $^{14}.0^{4}$, $^{13}.0^{6}$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl) phenyl]carbamoyl}butyl]carbamoyl}-2-methylpropyl]carbamoyl}-4-{3-[3-(2-{[(1S)-1-{[(1S)-1-{[(1S)-4-(carbamoylamino)-1-{[4-({[({[({[(10S,23S)-10-ethyl-18-fluoro-10-hydroxy-19-methyl-5,9-dioxo-8-oxa-4,15-diazahexacyclo[14.7.1.$0^{2}$, $^{14}.0^{4}$, $^{13}.0^{6}$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]oxy}methyl)phenyl]carbamoyl}butyl]carbamoyl}-2-methylpropyl]carbamoyl}-3-carboxypropyl]carbamoyl}ethoxy)-2-[3-(2-{2-[2-(cyclooct-2-yn-1-yloxy) acetamido]ethoxy}ethoxy)propanamido]propoxy]propanamido}butanoic Acid (LP39)

(LP39)

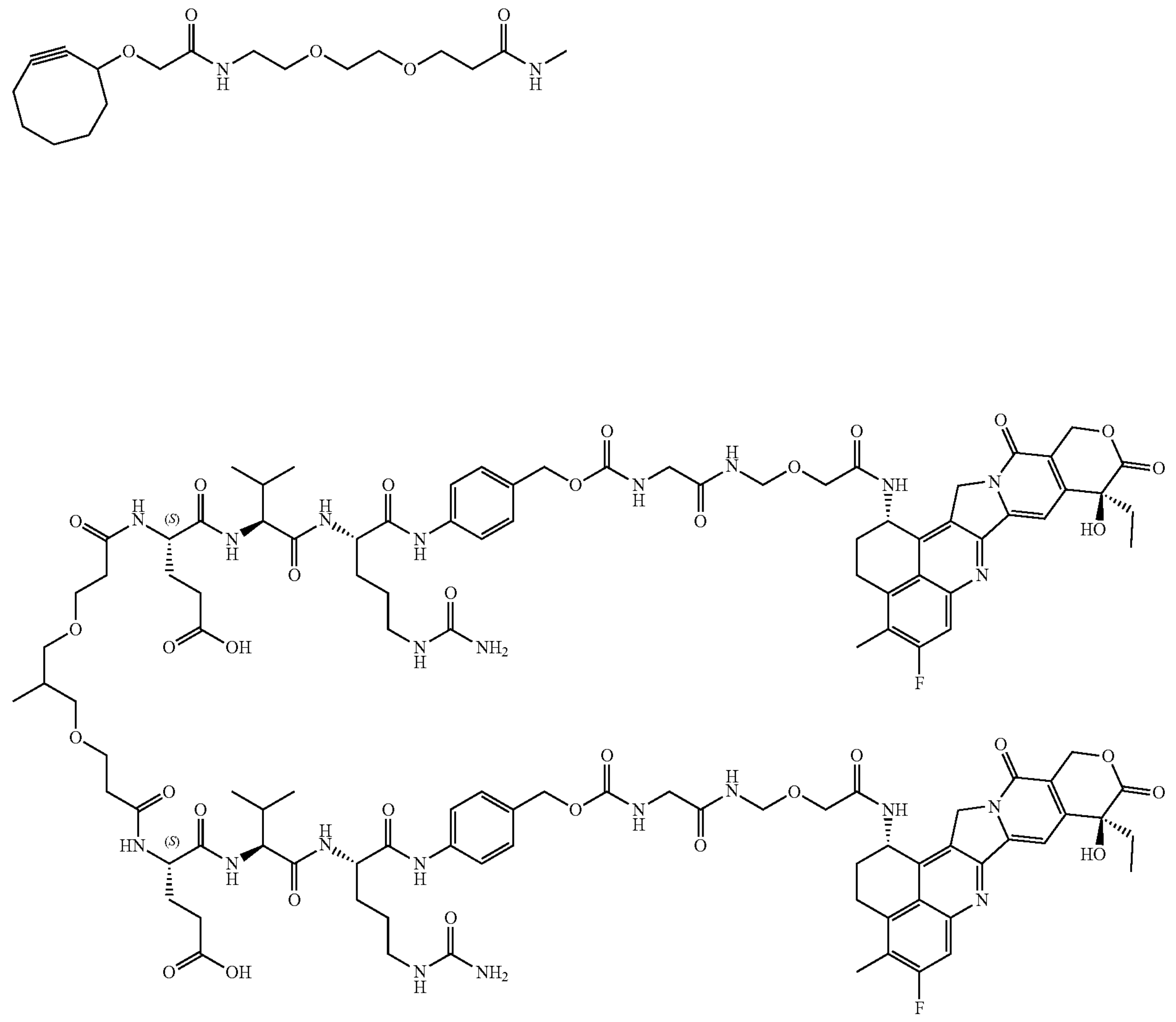

To a solution of LP39-3 (50 mg, 18 μmol) in THF (2 mL) was added aq. lithium hydroxide (0.08 M, 2 mL), and the reaction mixture was stirred at room temperature for an hour, which was monitored by LCMS. The mixture was purified by prep-HPLC (10-95% acetonitrile in aq. formic acid (0.1%)) to give LP39 (13 mg, 26% yield) as a white solid. ESI m/z: 917.7 $(M/3+H)^+$. $^1$H NMR (400 MHz, $DMSO_{d6}$) δ 10.03 (s, 2H), 8.79 (t, J=9.2 Hz, 2H), 8.50 (d, J=9.2 Hz, 2H), 8.17 (d, J=6.8 Hz, 2H), 8.07 (d, J=5.2 Hz, 2H), 7.80-7.75 (m, 4H), 7.74-7.70 (m, 1H), 7.58 (t, J=8.4 Hz, 4H), 7.45-7.40 (m, 2H), 7.30 (s, 2H), 7.27 (d, J=7.6 Hz, 4H), 6.52 (s, 2H), 6.01-6.95 (m, 2H), 5.64-5.56 (m, 2H), 5.46-5.39 (m, 8H), 5.21-5.16 (m, 4H), 4.92 (s, 4H), 4.62 (d, J=5.6 Hz, 4H), 4.40-4.32 (m, 4H), 4.30-4.25 (m, 1H), 4.22-4.16 (m, 2H), 4.01 (s, 4H), 3.90-3.84 (m, 1H), 3.78-3.72 (m, 1H), 3.64-3.55 (m, 10H), 3.47 (s, 4H), 3.43-3.39 (m, 3H), 3.26-3.23 (m, 3H), 3.17-3.12 (m, 2H), 3.05-3.00 (m, 2H), 2.96-2.91 (m, 2H), 2.38 (s, 9H), 2.35-2.30 (m, 5H), 2.26-2.15 (m, 12H), 2.00-1.95 (m, 2H), 1.89-1.80 (m, 7H), 1.73-1.66 (m, 5H), 1.62-1.52 (m, 5H), 1.47-1.31 (m, 6H), 0.90-0.79 (m, 21H) ppm. $^{19}$F NMR (376 MHz, $DMSO_{d6}$) δ −73.16, −111.30 ppm.

Scheme 12. Synthesis of asymmetric branched peptide linker-payload LP23
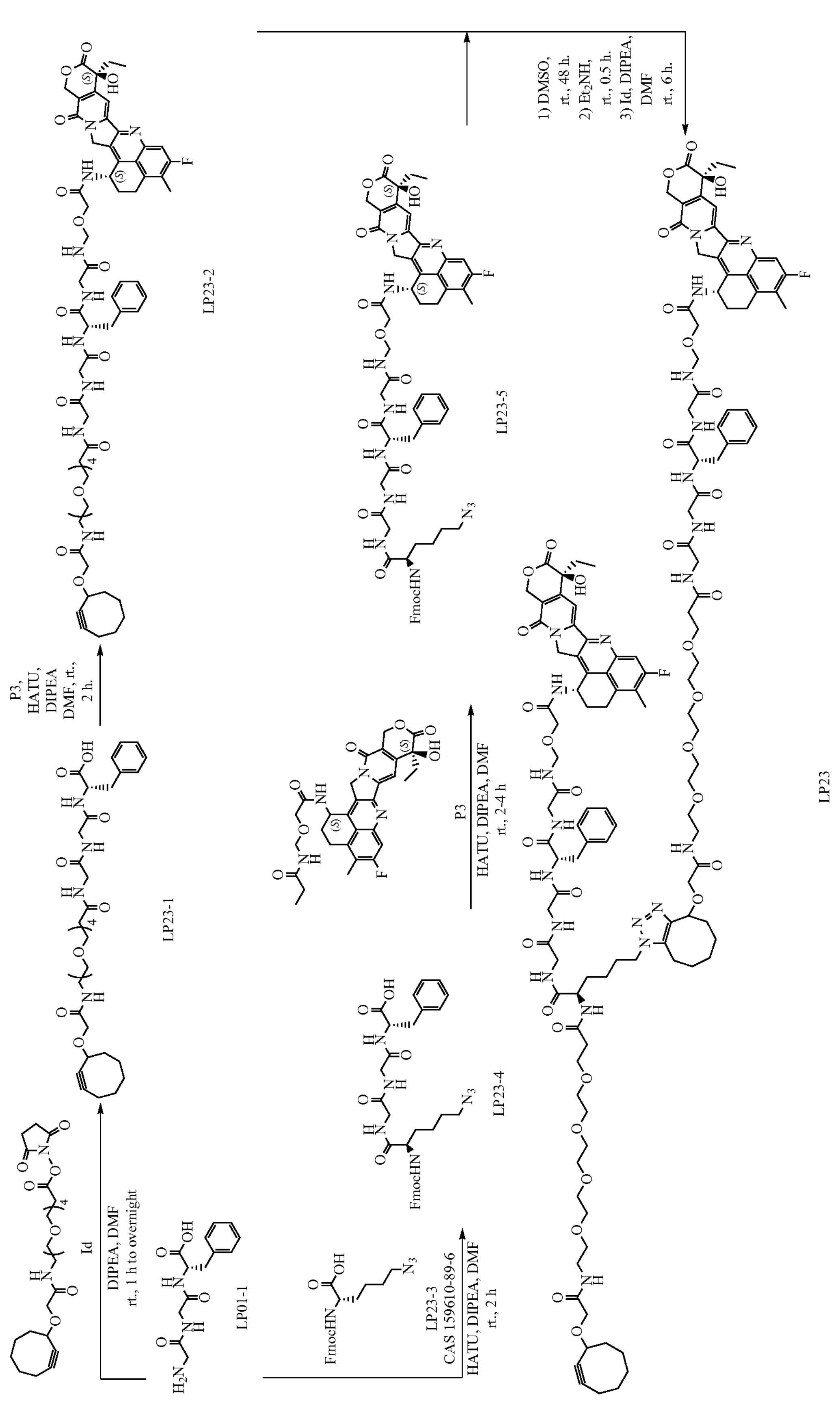

Example 7Y: (2S)-2-[2-(2-{1-[2-(cyclooct-2-yn-1-yloxy)acetamido]-3,6,9,12-tetraoxapentadecan-15-amido}acetamido)acetamido]-3-phenylpropanoic Acid (LP23-1)

(LP23-1)

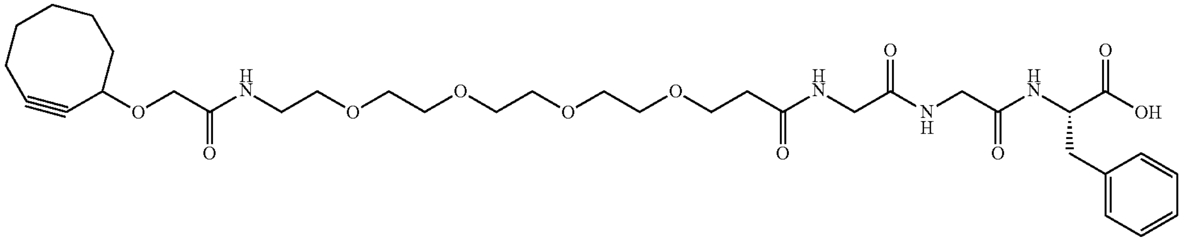

Following the similar procedure as LP9-2, except substituting Id for Ib, linker LP23-1 (88 mg, 53% yield) was obtained as colorless oil after purification by reversed phase flash chromatography (0-50% acetonitrile in aq. TFA (0.01%)). ESI m/z: 691.4 $(M+H)^+$.

Example 7Z: 1-[2-(Cyclooct-2-yn-1-yloxy)acetamido]-N-{[({[(1S)-1-[({[({[(10S,23S)-10-ethyl-18-fluoro-10-hydroxy-19-methyl-5,9-dioxo-8-oxa-4,15-diazahexacyclo[$14.7.1.0^2, {}^{14}.0^4, {}^{13}.0^6, {}^{11}.0^{20}, {}^{24}$]tetracosa-1,6(11),12,14,16,18,20(24)-heptaen-23-yl]carbamoyl}methoxy)methyl]carbamoyl}methyl)carbamoyl]-2-phenylethyl]carbamoyl}methyl)carbamoyl]methyl}-3,6,9,12-tetraoxapentadecan-15-amide (LP23-2)

(LP23-2)

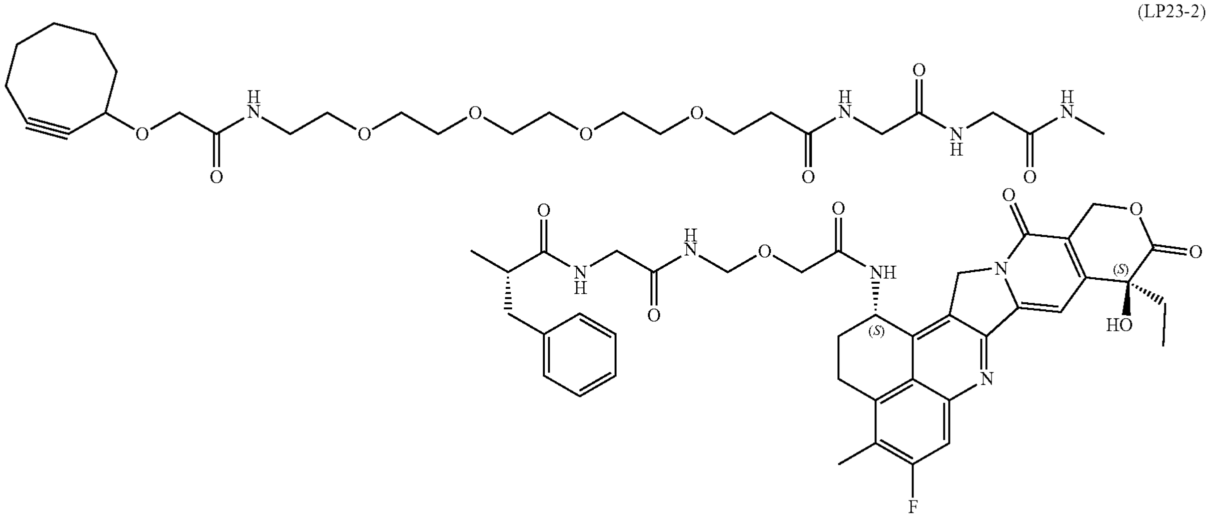

Following the similar procedure as LP9, except substituting LP23-1 for LP9-2, linker-payload LP23-2 (47 mg, 46% yield) was obtained as a light yellow solid. ESI m/z: 494.4 $(M_{Dxd}+1)^+$ Example 7AA: (2S)-2-(2-{2-[(2R)-6-Azido-2-({[(9H-fluoren-9-yl)methoxy]carbonyl}amino)hexanamido]acetamido}acetamido)-3-phenylpropanoic Acid (LP23-4)

(LP23-4)

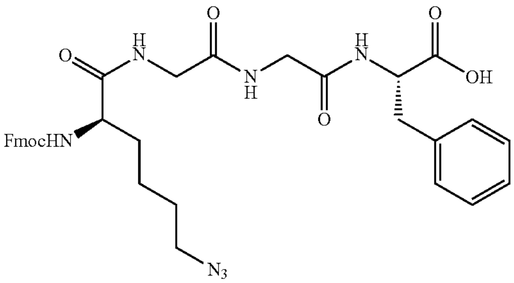

To a solution of compound LP23-3 (CAS: 159610-89-6, 0.39 g, 1.0 mmol) in dry DMF (5 mL) was added HATU (0.38 g, 1.0 mmol), and the solution was stirred at room temperature for 5 minutes before the addition of LP01-1 (0.30 g, 1.0 mmol) and DIPEA (0.26 g, 2.0 mmol). The reaction mixture was stirred at room temperature for 2 hours, which was monitored by LCMS. The resulting solution was then purified by reversed phase flash chromatography (0-90% acetonitrile in aq. TFA (0.01%)) to provide compound LP23-4 (0.50 g, 76% yield) as a white solid. ESI m/z: 656.3 $(M+H)^+$. $^1H$ NMR (400 MHz, $DMSO_{d6}$) δ 12.77 (s, 1H), 8.18-8.12 (m, 2H), 8.00 (d, J=5.2 Hz, 1H), 7.90 (d, J=7.6 Hz, 2H), 7.73 (t, J=6.8 Hz, 2H), 7.56 (d, J=8.4 Hz, 1H), 7.44-7.40 (m, 2H), 7.35-7.31 (m, 2H), 7.29-7.19 (m, 5H), 4.47-4.40 (m, 1H), 4.34-4.20 (m, 3H), 4.04-3.98 (m, 1H), 3.77-3.64 (m, 4H), 3.31 (t, J=6.8 Hz, 2H), 3.07-3.02 (m, 1H), 2.91-2.85 (m, 1H), 1.75-1.65 (m, 1H), 1.60-1.50 (m, 3H), 21.42-1.28 (m, 2H) ppm.

Example 7AB: (9H-Fluoren-9-yl)methyl N-[(1R)-5-azido-1-({[({[(1S)-1-[({[({[(10S,23S)-10-ethyl-18-fluoro-10-hydroxy-19-methyl-5,9-dioxo-8-oxa-4,15-diazahexacyclo[14.7.1.$0^2$, $^{14}.0^4$, $^{13}.0^6$, $^{11}.0^{20}$, $^{24}$]tetracosa-1,6(11),12,14,16,18,20(24)-heptaen-23-yl]carbamoyl}methoxy)methyl]carbamoyl}methyl)carbamoyl]-2-phenylethyl]carbamoyl}methyl)carbamoyl]methyl}carbamoyl)pentyl]carbamate (LP23-5)

(LP23-5)

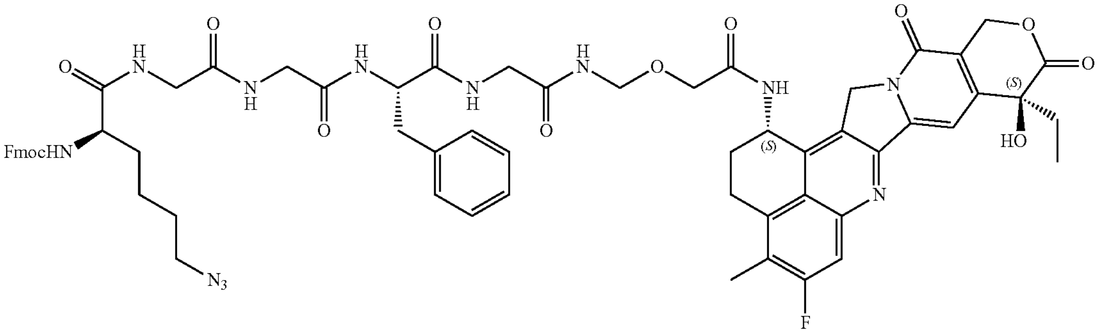

Following the similar procedure as LP9, except substituting LP23-4 for LP9-2, compound LP23-5 (60 mg, 64% yield) was obtained as a light yellow solid. ESI m/z: not detected any mass.-

Example 7AC: 1-[2-(Cyclooct-2-yn-1-yloxy)acetamido]-N-[(1R)-1-({[({[(1S)-1-[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]-2-phenylethyl]carbamoyl}methyl)carbamoyl]methyl}carbamoyl)-5-[4-({[14-({[({[(1S)-1-[({[({[(10S,23S)-10-ethyl-18-fluoro-10-hydroxy-19-methyl-5,9-dioxo-8-oxa-4,15-diazahexacyclo[14.7.1.0$^{2}$, $^{14}$.0$^{4}$, $^{13}$.0$^{6}$, $^{11}$.0$^{20}$, $^{24}$]tetracosa-1,6(11),12,14,16,18,20(24)-heptaen-23-yl]carbamoyl}methoxy)methyl]carbamoyl}methyl)carbamoyl]-2-phenylethyl]carbamoyl}methyl)carbamoyl]methyl}carbamoyl)-3,6,9,12-tetraoxatetradecan-1-yl]carbamoyl}methoxy)-1H,4H,5H,6H,7H,8H,9H-cycloocta[d][1,2,3]triazol-1-yl]pentyl]-3,6,9,12-tetraoxapentadecan-15-amide (LP23)

tography (0-50% acetonitrile in aq. TFA (0.01%)) to give a light yellow solid (30 mg, ESI m/z: 494, Rt=1.63 min.), 20 mg of which was dissolved in dry DMF (4 mL). To which were added DIPEA (2.3 mg, 18 μmol) and a solution of Id (4.7 mg, 8.9 μmol) in dry DMF (1 mL). The reaction mixture was stirred at room temperature for 6 hours, which was monitored by LCMS. The resulting mixture was directly purified by reversed phase flash chromatography (0-100% acetonitrile in aq. TFA (0.01%)) to give crude LP23 (62% purity) as a white solid, which was further purified by prep-HPLC (0-100% acetonitrile in aq. TFA (0.01%)) to give pure LP23 (2.5 mg, 3.5% yield) as a white solid. ESI m/z: 887.6 (M/3+H)$^+$. $^1$H NMR (400 MHz, DMSO$_{d6}$) δ 8.63 (t, J=6.8 Hz, 2H), 8.50 (d, J=9.2 Hz, 2H), 8.33-8.27 (m, 2H), 8.18-8.09 (m, 4H), 8.05-7.95 (m, 3H), 7.81-7.75 (m, 3H), 7.59 (t, J=6.0 Hz, 1H), 7.31 (s, 2H), 7.26-7.14 (m, 10H), 7.09 (s, 0.5H), 6.97 (s, 0.5H), 6.52 (brs, 2H), 5.62-5.57 (m, 2H), 5.41 (s, 4H), 5.19 (s, 4H), 4.75-4.72 (m, 1H), 4.64 (d, J=6.4 Hz, 4H), 4.52-4.43 (m, 2H), 4.30-4.18 (m, 4H), 4.02

(LP23)

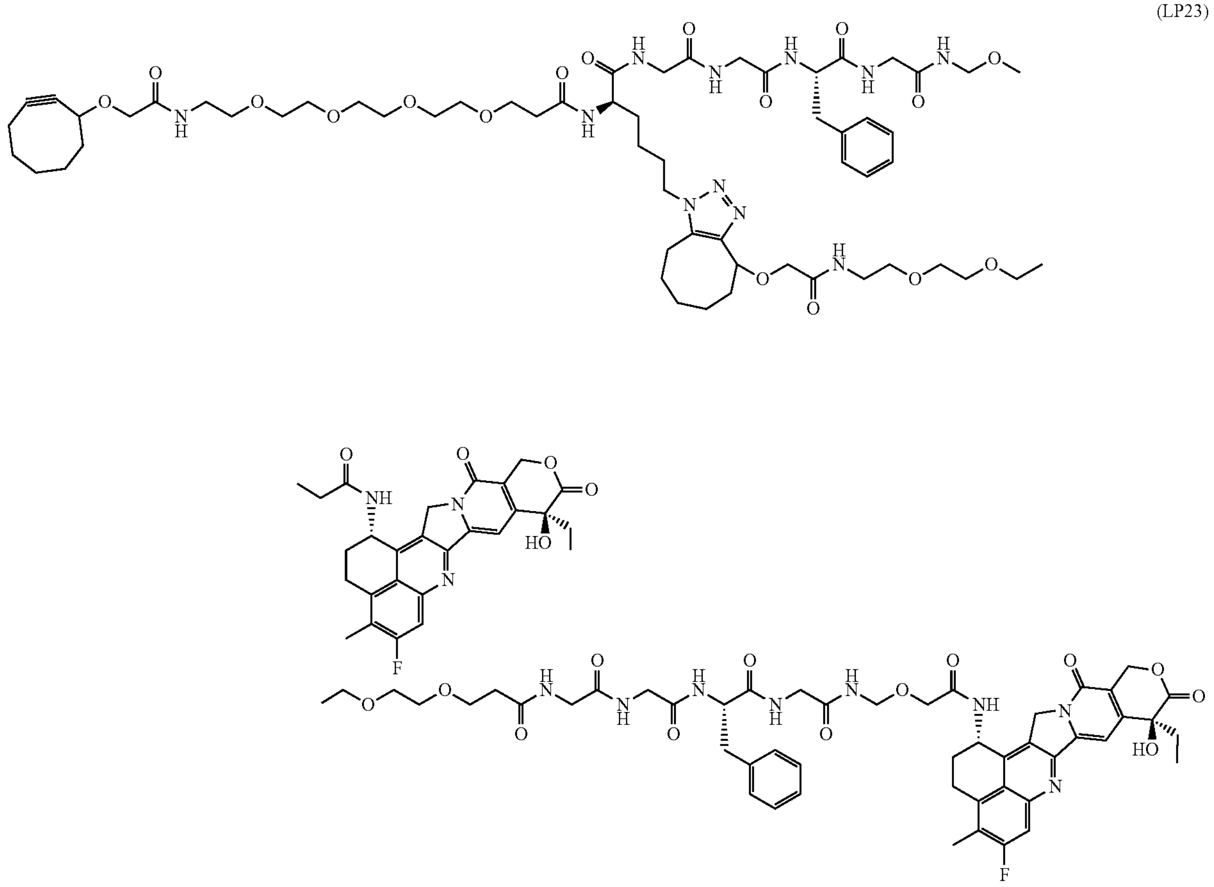

A yellow solution of LP23-5 (45 mg, 38 μmol) and LP23-2 (47 mg, 38 μmol) in DMSO (3 mL) was stirred at room temperature for 48 hours, which was monitored by LCMS. The resulting mixture was directly purified by reversed phase flash chromatography (0-50% acetonitrile in aq. TFA (0.01%)) to give a light yellow solid (60 mg, ESI m/z: 494, Rt=1.88 min.), which was dissolved in DMF (1.8 mL). To the solution was added diethylamine (0.2 mL), and the reaction mixture was stirred at room temperature for half an hour until Fmoc was totally removed according to LCMS. The mixture was separated by reversed phase flash chroma- (s, 4H), 3.88-3.84 (m, 1H), 3.79-3.76 (m, 3H), 3.73-3.68 (m, 9H), 3.62-3.56 (m, 4H), 3.51-3.49 (m, 12H), 3.48-3.46 (m, 14H), 3.27-3.23 (m, 4H), 3.19-3.09 (m, 3H), 3.04-2.99 (m, 2H), 2.96-2.90 (m, 1H), 2.81-2.72 (m, 4H), 2.63-2.60 (m, 2H), 2.39-2.37 (m, 8H), 2.22-2.13 (m, 5H), 2.08-1.97 (m, 3H), 1.93-1.80 (m, 9H), 1.78-1.69 (m, 6H), 1.61-1.47 (m, 6H), 1.31-1.24 (m, 6H), 1.10-1.02 (m, 1H), 0.87 (t, J=7.6 Hz, 6H) ppm. $^{19}$F NMR (400 MHz, DMSO$_{d6}$) −73 (TFA), −111 (Ar—F) ppm.

Scheme 13. Synthesis of branched peptide linker-payload LP35
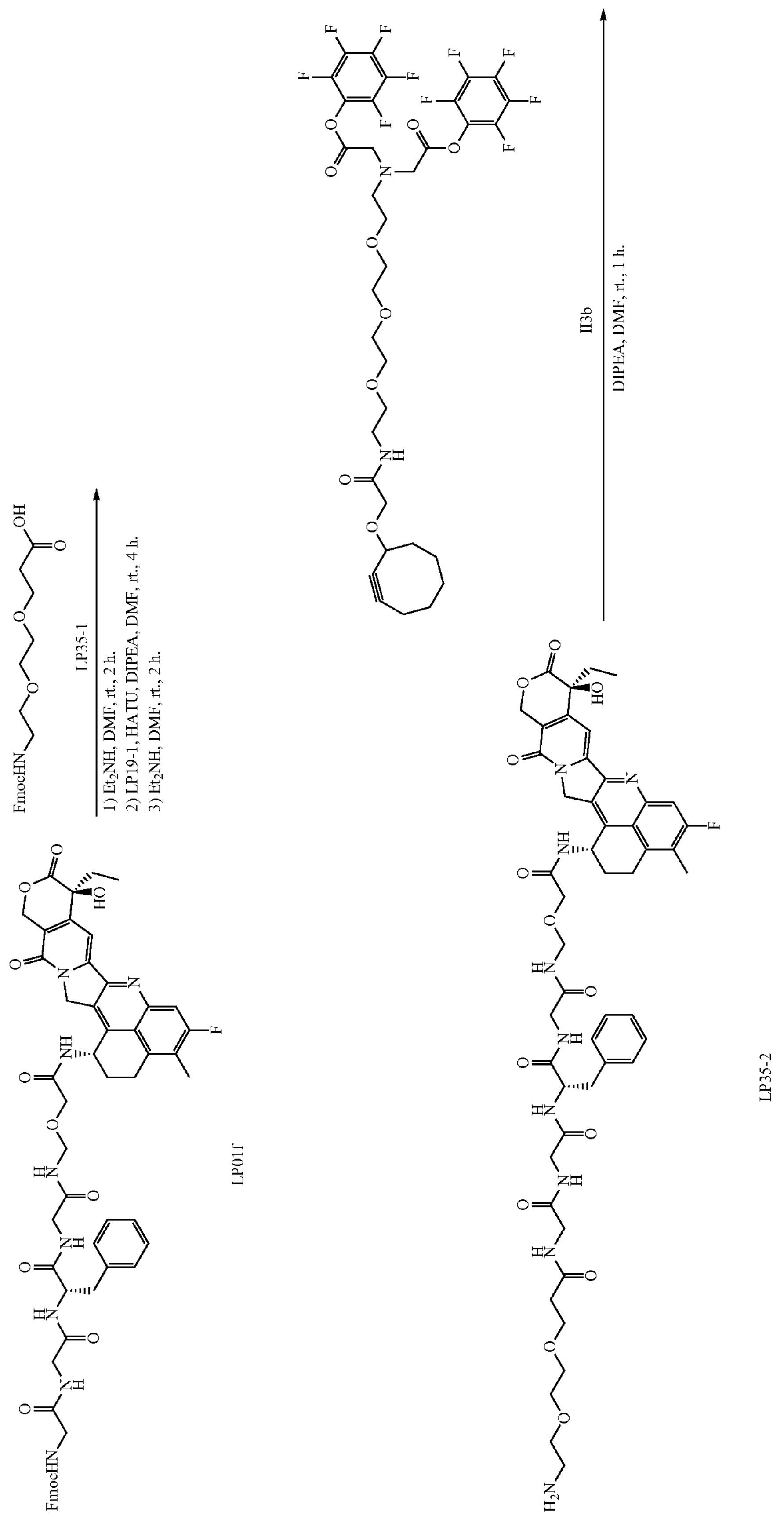

-continued
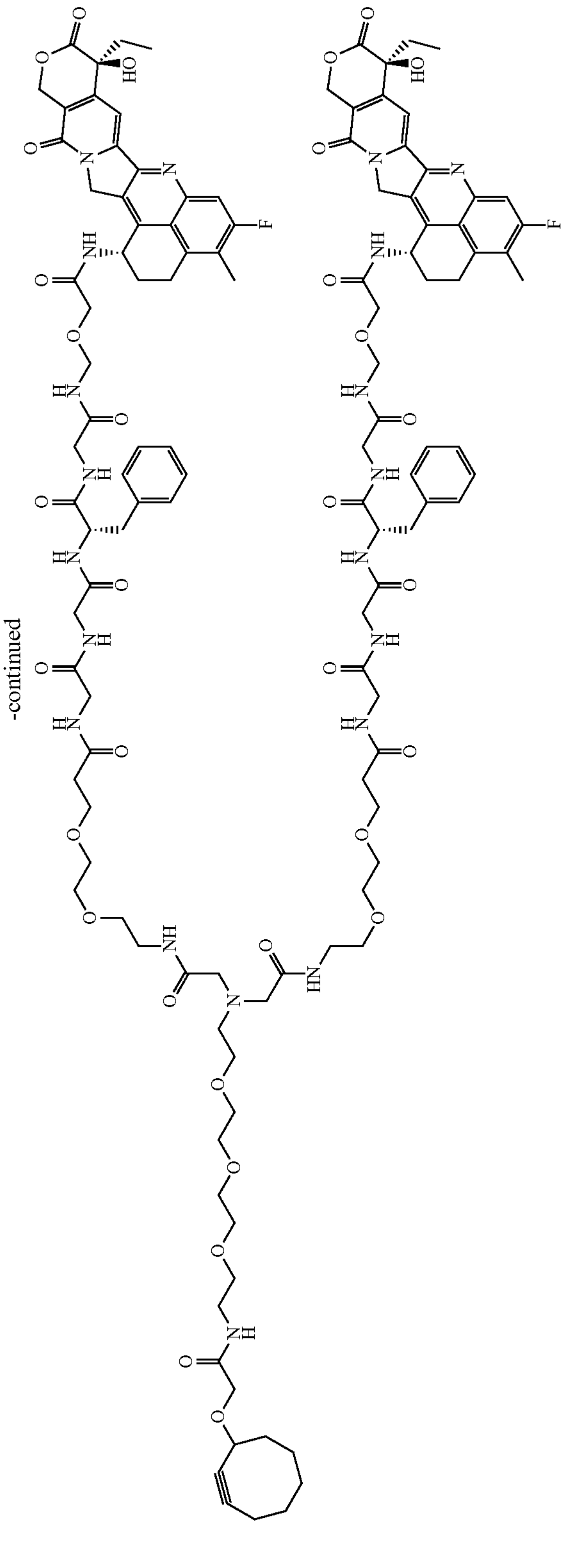
LP35

Example 7AD: (2S)-2-[2-(2-{3-[2-(2-Aminoethoxy)ethoxy]propanamido}acetamido)acetamido]-N-({[({[(10S,23S)-10-ethyl-18-fluoro-10-hydroxy-19-methyl-5,9-dioxo-8-oxa-4,15-diazahexacyclo[14.7.1.$0^2$, $^{14}$.$0^4$, $^{13}$.$0^6$, $^{11}$.$0^{20}$, $^{24}$]tetracosa-1,6(11)12,14,16,18,20(24)-heptaen-23-yl]carbamoyl}methoxy)methyl]carbamoyl}methyl)-3-phenylpropanamide (LP35-2)

(LP35-2)

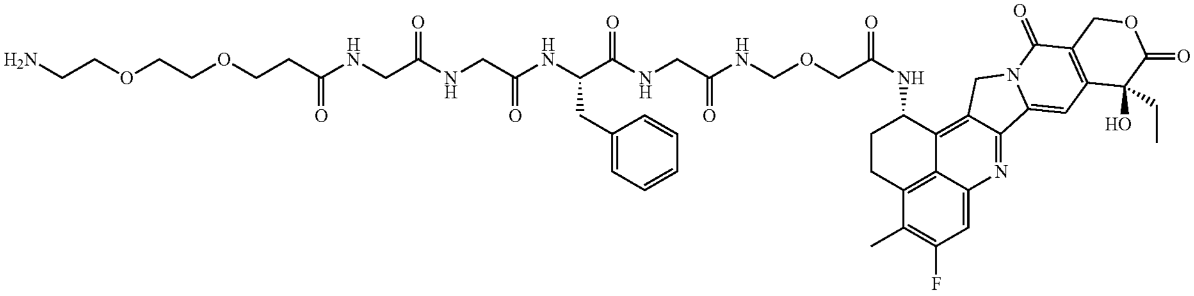

To a solution of LP01f (74 mg, 70 μmol) in DMF (5 mL) was added diethylamine (26 mg, 0.35 mmol). The mixture was stirred at room temperature for 2 hours until Fmoc was totally removed according to LCMS. The resulting mixture was separated by reserved phase flash chromatography (0-100% acetonitrile in aq. TFA (0.01%)) to give a white solid (58 mg, ESI m/z: 841.4 $(M+H)^+$), which was dissolved in DMF (5 mL). To the solution were successively added compound LP35-1 (28 mg, 69 μmol), DIPEA (18 mg, 0.14 mmol) and HATU (40 mg, 0.10 mmol), and the reaction mixture was stirred at room temperature for 4 hours, which was monitored by LCMS. The resulting mixture was separated by prep-HPLC (0-100% acetonitrile in aq. TFA (0.05%)) to give a white solid (54 mg, ESI m/z: 729.3 $(M-M_{Dxd}+H)^+$), which was dissolved in DMF (5 mL). To the solution was added diethylamine (16 mg, 0.22 mmol), and the mixture was stirred at room temperature for 2 hours until Fmoc was totally removed according to LCMS. The resulting mixture was directly purified by reversed phase flash chromatography (0-100% acetonitrile in aq. TFA (0.01%)) to give LP35-2 (40 mg, 57% yield from LP01f) as a white solid. ESI m/z: 1000.5 $(M+H)^+$, 500.8 $(M/2+H)^+$.

Example 7AE: 1-[2-(Cyclooct-2-yn-1-yloxy)acetamido]-N-(2-{2-[2-({[({[(1S)-1-[({[({[(10S,23S)-10-ethyl-18-fluoro-10-hydroxy-19-methyl-5,9-dioxo-8-oxa-4,15-diazahexacyclo[14.7.1.$0^2$, $^{14}$.$0^4$, $^{13}$.$0^6$, $^{11}$.$0^{20}$, $^{24}$]tetracosa-1,6(11),12,14,16,18,20(24)-heptaen-23-yl]carbamoyl}methoxy)methyl]carbamoyl}methyl)carbamoyl]-2-phenylethyl]carbamoyl}methyl)carbamoyl]methyl}carbamoyl)ethoxy]ethoxy}ethyl)-12-{[(2-{2-[2-({[({[(1S)-1-[({[({[(10S,23S)-10-ethyl-18-fluoro-10-hydroxy-19-methyl-5,9-dioxo-8-oxa-4,15-diazahexacyclo[14.7.1.$0^2$, $^{14}$.$0^4$, $^{13}$.$0^6$, $^{11}$.$0^{20}$, $^{24}$]tetracosa-1,6(11),12,14,16,18,20(24)-heptaen-23-yl]carbamoyl}methoxy)methyl]carbamoyl}methyl)carbamoyl]-2-phenylethyl]carbamoyl}methyl)carbamoyl]methyl}carbamoyl)ethoxy]ethoxy}ethyl)carbamoyl]methyl}-3,6,9-trioxa-12-azatetradecan-14-amide (LP35)

(LP35)

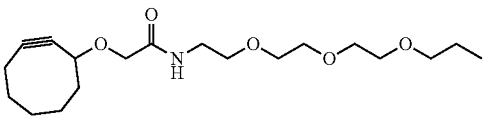

-continued

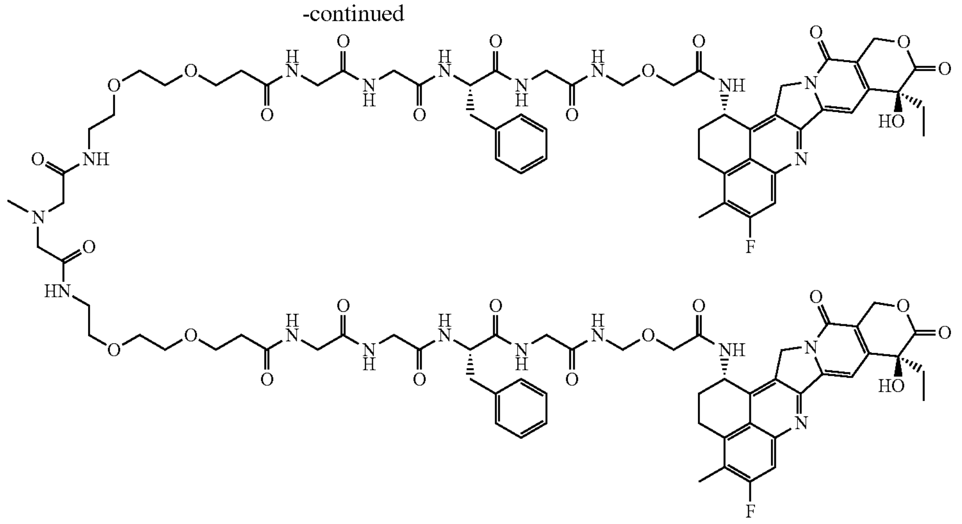

Following the similar procedure as LP24 except starting from LP35-2 (40 mg, 40 μmol) and intermediate II3b (16 mg, 20 μmol), branched linker-payload LP35 (12 mg, 24% yield) was obtained as a white solid after purification by prep-HPLC (5-95% acetonitrile in aq. TFA (0.05%)). ESI m/z: 812.7 $(M/3+H)^+$. $^1H$ NMR (400 MHz, $DMSO_{d6}$) δ 8.64 (t, J=6.6 Hz, 2H), 8.52 (d, J=8.7 Hz, 2H), 8.31 (t, J=5.9 Hz, 2H), 8.19-8.09 (m, 4H), 8.05-7.98 (m, 3H), 7.77 (d, J=10.9 Hz, 2H), 7.65-7.56 (m, 2H), 7.31 (s, 2H), 7.29-7.12 (m, 8H), 6.53 (s, 2H), 5.65-5.56 (m, 3H), 5.42 (s, 3H), 5.20-5.15 (m, 3H), 4.70-4.60 (m, 3H), 4.50-4.44 (m, 2H), 4.30-4.22 (m, 2H), 4.02 (s, 3H), 3.86 (d, J=14.8 Hz, 2H), 3.78-3.66 (m, 9H), 3.63-3.55 (m, 6H), 3.53-3.40 (m, 27H), 3.27-3.19 (m, 6H), 3.15 (s, 4H), 3.09-3.00 (m, 2H), 2.81-2.72 (m, 2H), 2.70-2.63 (m, 2H), 2.42-2.32 (m, 8H), 2.25-2.11 (m, 6H), 2.09-1.97 (m, 3H), 1.94-1.68 (m, 9H), 1.63-1.51 (m, 3H), 1.43-1.34 (m, 2H), 1.29-1.20 (m, 3H), 0.87 (t, J=7.3 Hz, 6H) ppm. $^{19}F$ NMR (376 MHz, $DMSO_{d6}$) δ −111.24 ppm. (no TFA signal)

Example 8: Quenched Linker-Payloads qLP18, qLP29, qLP33, qLP40, qLP42

Generic Synthesis of Quenched Linker-Payload

To a solution of the linker-payload (1 equiv.) in DMF (1-5 mM) was added amino azide AL1 (1-1.5 equiv.). The reaction mixture was stirred at room temperature for 1-3 hours until the linker-payload was totally quenched, which was monitored by LCMS. Then the mixture was purified by reversed phase flash chromatography to give the quenched Linker-P as a white solid.

TABLE 13

Chemical properties of quenched linker-payloads

| LP# | qLP# | Name | yield | ESI m/z | Rt (min) in LCMS |
|---|---|---|---|---|---|
| LP1 | qLP18 | $NH_2$-$PEG_3$-TCOT-$PEG_4$-vcPAB-G-$NHCH_2$-Dxd | 59% | 808.5 $(M/2 + H)^+$, 539.2 $(M/3 + H)^+$ | 1.03 |
| LP28 | qLP29 | $NH_2$-$PEG_3$-TCOT-B3-[NH-$PEG_2$-$^{D}$EvcPAB-G-$NHCH_2$-Dxd]$_2$ | 37% | 801.3 $(M/4 + H)^+$, 1067.8 $(M/3 + H)^+$ | 1.41 |
| LP32 | qLP33 | $NH_2$-$PEG_3$-TCOT-B3-[NH-$PEG_2$-$^{L}$EvcPAB-G-$NHCH_2$-Dxd]$_2$ | 35% | 801.0 $(M/4 + H)^+$ | 1.43 |
| LP39 | qLP40 | $NH_2$-$PEG_3$-TCOT-$PEG_2$-B4-[NH-$^{L}$EVCPAB-G-$NHCH_2$-Dxd]$_2$ | 34% | 991.2 $(M/3 + H)^+$ | 1.44 |
| LP41 | qLP42 | $NH_2$-$PEG_3$-TCOT-$PEG_2$-B5-[NH-$PEG_2$-$^{L}$EVCPAB-G-$NHCH_2$-Dxd]$_3$ | 38% | 929.7 $(M/5 + H)^+$, 1161.9 $(M/4 + H)^+$ | 1.47 |

Example 9: Exemplary Linkers L1-B for Transglutaminase Bioconjugation

According to one embodiment of the present disclosure, linkers L1-B may be azide amine linkers (AL), which comprise an amine group which directly attaches to the antibody, a PEG-containing base structure, and an azide functional group (B', n=1).

Two azide amine linkers are conjugated to the Q295 residue of antibodies with a WT Fc domain that are enzymatically deglycosylated, or antibodies with an N297D mutation, resulting in an azido-functionalized antibody with two attachments and two azide functional groups available for further modification (DAR=2n). Four azide amine linkers are conjugated to the Q295 and Q297 residues of antibodies with an N297Q mutation in the Fc domain, resulting in an azido-functionalized antibody with four attachments and four azide functional groups available for further modification (DAR=4n). The basic component structures of non-limiting exemplary azide amine linkers are shown in FIG. 3B. Specific structures synthesized as examples are provided below in Table 14.

n, where n is the number of azides on each branched BL1 linker) available for further modification. Four branched-alkyl azide amine linkers are conjugated to the Q295 and

TABLE 14

Amino-azido linkers synthesized as examples

| Cpd# | Structure | LC-MS m/z (100%) | MF | FW |
|---|---|---|---|---|
| AL1 | 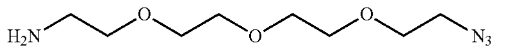 | 219.2 [M + H]$^+$ | $C_8H_{18}N_4O_3$ | 218.25 |
| AL2 | 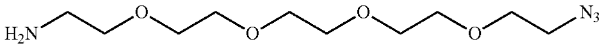 [SMILES: [N-]=[N+]=NCCOCCOCCOCCOCCN] | 263.2 [M + H]$^+$ | $C_{10}H_{22}N_4O_4$• $2CF_3COOH$ | 490.35 |
| AL3 | 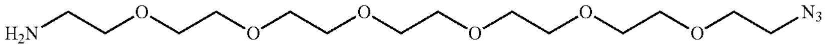 [SMILES: [N-]=[N+]=NCCOCCOCCOCCOCCOCCOCCN] | 351.3 [M + H]$^+$ | $C_{14}H_{30}N_4O_6$ | 350.41 |
| AL4 | 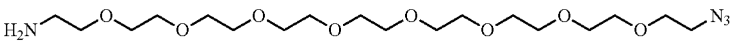 | 439.3 [M + H]$^+$ | $C_{32}H_{68}N_8O_{14}$ | 438.52 |
| AL5 | 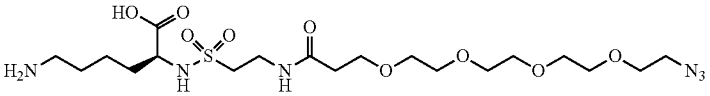 [SMILES: [N-]=[N+]=NCCOCCOCCOCCOCCC(=O)NCCS(=O)(=O)N[C@@H](CCCCN)C(=O)O] | 527.6 [M + H]$^+$ | $C_{19}H_{38}N_6O_9S$ | 526.60 |
| AL6 | 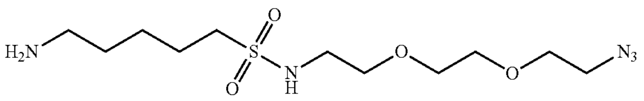 [SMILES: [N-]=[N+]=NCCOCCOCCNS(=O)(=O)CCCCCN] | 324.2 [M + H]$^+$ | $C_{11}H_{25}N_5O_4S$• HCOOH | 369.44 |
| AL7 | 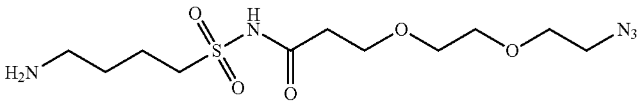 [SMILES: [N-]=[N+]=NCCOCCOCCC(=O)NS(=O)(=O)CCCCN] | 338.2 [M + H]$^+$ | $C_{11}H_{23}N_5O_5S$ • HCOOH | 383.42 |
| AL8 | 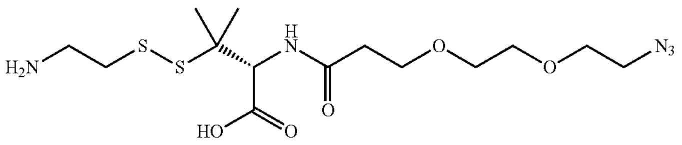 [SMILES: CC(C)(SSCCN)[C@H](NC(=O)CCOCCOCCN=[N+]=[N-])C(=O)O] | 410.0 [M + H]$^+$ | $C_{14}H_{27}N_5O_5S_2$• $CF_3COOH$ | 523.55 |
| AL9 | 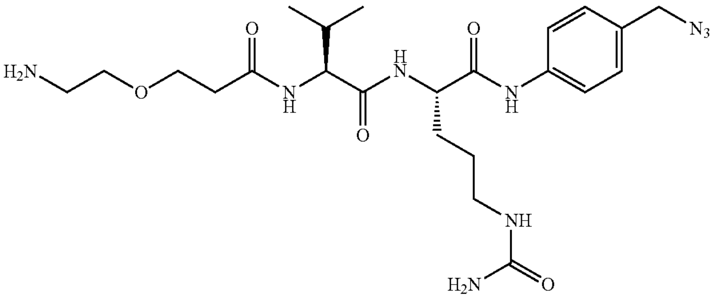 [SMILES: CC(C)[C@H](NC(=O)CCOCCN)C(=O)N[C@@H](CCCNC(N)=O)C(=O)Nc1ccc(CN=[N+]=[N-])cc1] | 520.3 [M + H]$^+$ | $C_{23}H_{37}N_9O_5$ | 519.60 |

According to another embodiment of the present disclosure, linkers L1 may be branched-alkyl azide amine linkers (BL) contain an amine group which directly attaches to the antibody branched-alkyl PEG containing base structure and 2 to 6 azide functional groups (n=2-6).

Two branched-alkyl azide amine linkers are conjugated to the Q295 residue of antibodies with a WT Fc domain that are enzymatically deglycosylated or antibodies with N297D mutations, resulting in an azido functionalized antibody with two attachments and 4-12 azide functional groups (2 times Q297 residues of antibodies with an N297Q mutation in the Fc domain, resulting in an azido functionalized antibody with four attachments and 8-24 azide functional groups (4 times n) available for further modification. The basic component structures of possible Branched-alkyl azide amine linkers are listed in FIG. 4B. Specific structures synthesized as examples are provided in Table 15.

TABLE 15
| Branched linkers synthesized as examples | | | | |
|---|---|---|---|---|
| Cpd# | Structure | LC-MS m/z (100%) | MF | FW |
| BL1 | 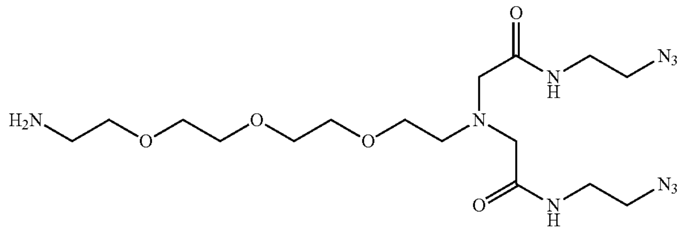 [SMILES: [N-]=[N+]=NCCNC(=O)CN(CCOCCOCCOCCN)CC(=O)NCCN=[N+]=[N-]] | 445.3 [M + H]+ | $C_{16}H_{32}N_{10}O_5$• $CF_3COOH$ | 558.51 |
| BL2 | 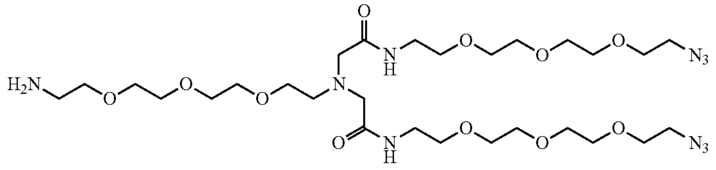 [SMILES: [N-]=[N+]=NCCOCCOCCOCCNC(=O)CN(CCOCCOCCOCCN)CC(=O)NCCOCCOCCOCCN=[N+]=[N-]] | 709.5 [M + H]+ | $C_{28}H_{56}N_{10}O_{11}$ | 708.8 |
| BL3 | 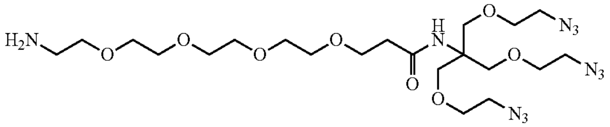 [SMILES: [N-]=[N+]=NCCOCC(COCCN=[N+]=[N-])(COCCN=[N+]=[N-])NC(=O)CCOCCOCCOCCOCCN] | 576.4 [M + H]+ | $C_{21}H_{41}N_{11}O_8$ | 575.63 |
| BL4 | 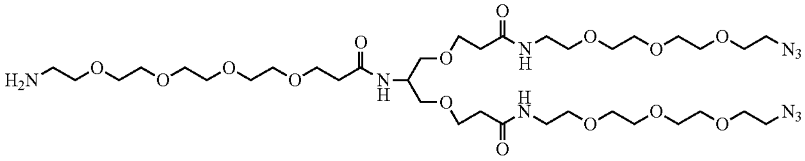 [SMILES: [N-]=[N+]=NCCOCCOCCOCCNC(=O)CCOCC(COCCC(=O)NCCOCCOCCOCCN=[N+]=[N-])NC(=O)CCOCCOCCOCCOCCN] | 883.5 [M + H]+ | $C_{36}H_{70}N_{10}O_{15}$ | 883.00 |
| BL5 | 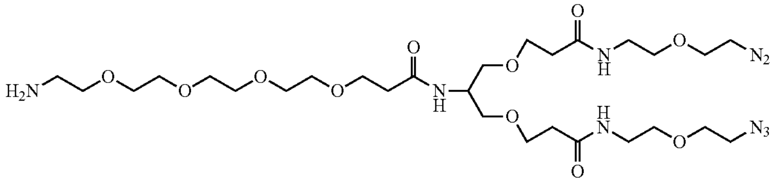 | 707.4 [M + H]+ | $C_{28}H_{54}N_{10}O_{11}$ | 706.79 |
| BL6 | 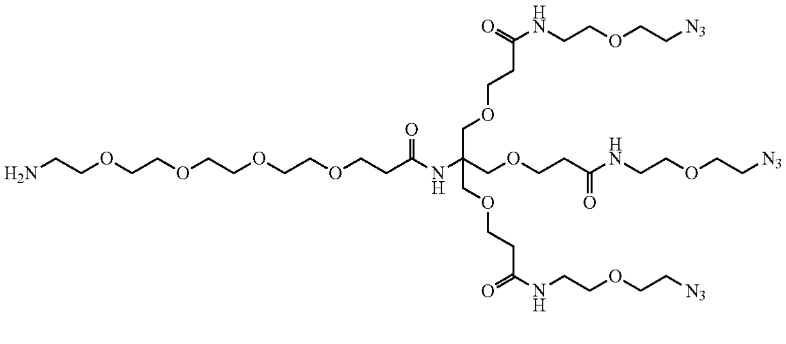 [SMILES: [N-]=[N+]=NCCOCCNC(=O)CCOCC(COCCC(=O)NCCOCCN=[N+]=[N-])(COCCC(=O)NCCOCCN=[N+]=[N-])NC(=O)CCOCCOCCOCCOCCN] | 921.6 [M + H]+ | $C_{36}H_{68}N_{14}O_{14}$ | 921.01 |
| BL7 | 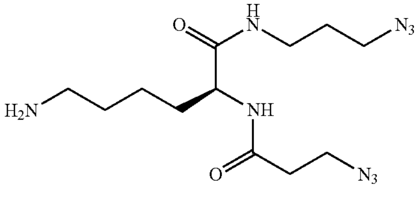 [SMILES: [N-]=[N+]=NCCCNC(=O)[C@H](CCCCN)NC(=O)CCN=[N+]=[N-]] | 326.2 [M + H]+ | $C_{12}H_{23}N_9O_2$ | 325.38 |

TABLE 15-continued
| Branched linkers synthesized as examples | | | | |
|---|---|---|---|---|
| Cpd# | Structure | LC-MS m/z (100%) | MF | FW |
| BL10 | 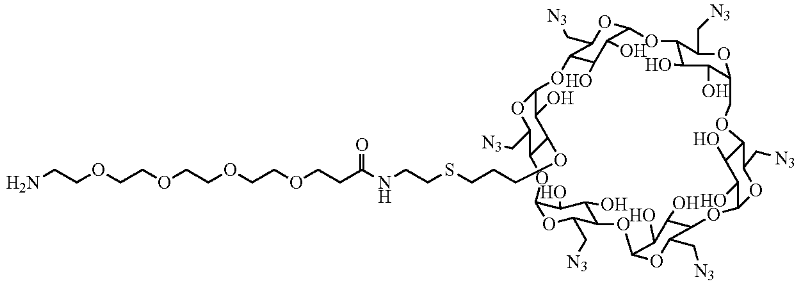 [SMILES: [N-]=[N+]=NCC1OC2COC3C(CN=[N+]=[N-])OC(OC4C(CN=[N+]=[N-])OC(OC5C(CN=[N+]=[N-])OC(OC6C(CN=[N+]=[N-])OC(OC7C(CN=[N+]=[N-])OC(OC1C(O)C2O)C(O)C7O)C(O)C6OCCCSCCNC(=O)CCOCCOCCOCCOCCN)C(O)C5O)C(O)C4O)C(O)C3O] | 1488.2 [M + H]+ | $C_{52}H_{86}N_{20}O_{29}S$ | 1487.42 |
| BL11 | 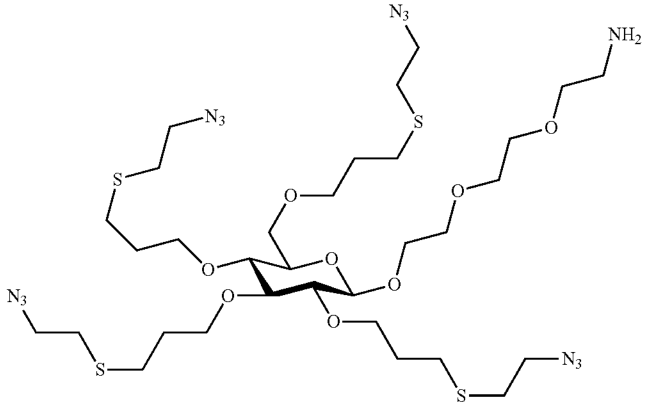 | 884.5 [M + H]+ | $C_{20}H_{37}N_{13}O_8$ | 587.59 |
| BL12 | 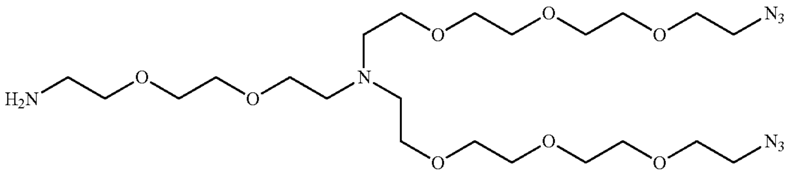 [SMILES: [N-]=[N+]=NCCOCCOCCOCCN(CCOCCOCCN)CCOCCOCCOCCN=[N+]=[N-]] | | | 550.66 |
Amino-azido linkers AL1 (CAS: 134179-38-7), AL2 (CAS: 951671-92-4), AL3 (CAS: 957486-82-7) and AL4 (CAS: 857891-82-8) were commercially obtained. Amino-tetrazine linker AL10 (CAS: 2055646-21-2) was reported in WO2016209062, incorporated by reference herein. Branched linker BL7 (CAS: 2253947-15-6) was reported in WO2018218004, incorporated by reference herein.

Example 10: Synthesis of AL5 Linker

Amino-azido linker AL5 was synthesized as described in Scheme 14 and Examples 10A-10D, below.

Scheme 14: Synthesis of amino-azido linker AL5

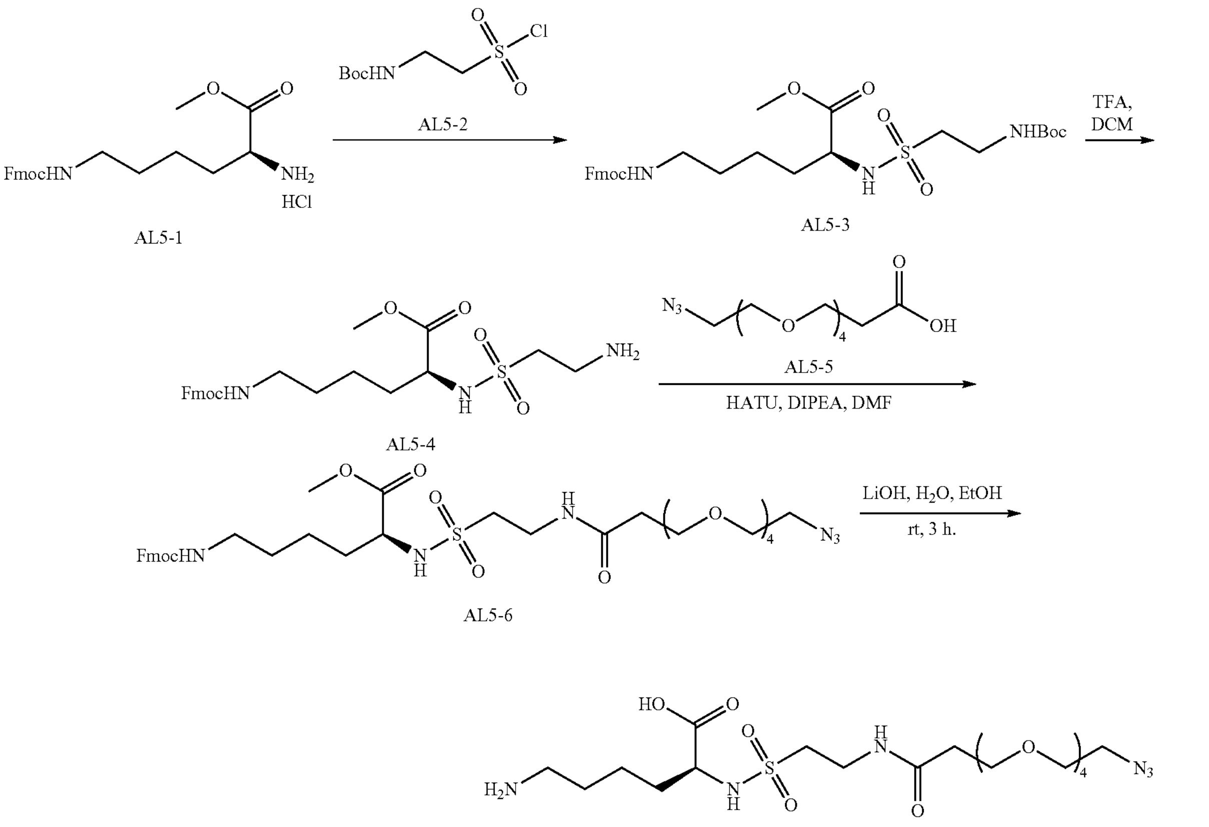

AL5-1
AL5-2
AL5-3
AL5-4
AL5-5
AL5-6
AL5

Example 10A: Methyl (2S)-2-(2-{[(tert-butoxy)carbonyl]amino}ethanesulfonamido)-6-{[(9H-fluoren-9-ylmethoxy)carbonyl]amino}hexanoate (AL5-3)

(AL5-3)

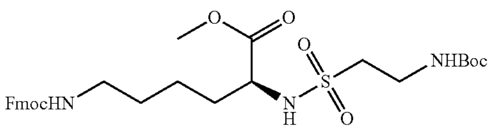

To a solution of H-Lys(Fmoc)-OMe·HCl (AL5-1, CAS: 201009-98-5) (0.38 g, 1.0 mmol) in DCM (10 mL) were added triethylamine (0.30 g, 3.0 mmol), DMAP (0.12 g, 1.0 mmol) and compound AL5-2 (CAS: 134019-73-1) (0.25 g, 1.0 mmol). The reaction was stirred at RT for 4 hours; reaction completion was monitored by LCMS. The mixture was directly purified by reversed phase flash chromatography (0-100% acetonitrile in aq. TFA (0.01%)) to give compound AL5-3 (0.30 g, 50% yield) as viscous oil. ESI m/z: 612.3 $(M+Na)^+$.

Example 10B: Methyl (2S)-2-(2-aminoethanesulfonamido)-6-{[(9H-fluoren-9-ylmethoxy)carbonyl]amino}hexanoate (AL5-4)

(AL5-4)

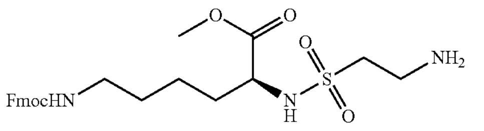

To a solution of compound AL5-3 (0.30 g, 0.51 mmol) in DCM (10 mL) was added TFA (2 mL), and the reaction mixture was stirred at RT for 4 hours until Boc was totally removed, which was monitored by LCMS. The resulting mixture was concentrated in vacuo and the residue was purified by reversed phase flash chromatography (0-100% acetonitrile in aq. TFA (0.01%)) to give compound AL5-4 (0.20 g, 80% yield) as viscous oil. ESI m/z: 490.1 $(M+H)^+$.

Example 10C: Methyl (2S)-2-[2-(1-azido-3,6,9,12-tetraoxapentadecan-15-amido) ethanesulfonamido]-6-{[(9H-fluoren-9-ylmethoxy)carbonyl] amino}hexanoate (AL5-6)

(AL5-6)

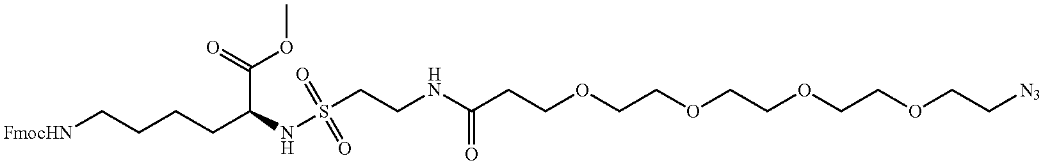

To a solution of compound AL5-5 (0.12 g, 0.41 mmol) in DMF (10 mL) were added compound HATU (0.16 g, 0.42 mmol) and DIPEA (0.11 g, 0.85 mmol), and the reaction mixture was stirred at RT for 10 minutes before the addition of compound AL5-4 (0.20 g, 0.41 mmol). The reaction mixture was stirred at RT for 2 hours. The resulting mixture was directly purified by reversed phase flash chromatography (0-100% acetonitrile in aq. ammonium bicarbonate (10 mM)) to give compound AL5-6 (0.25 g, 80% yield) as colorless oil. ESI m/z: 763.3 $(M+H)^+$.

Example 10D: (2S)-6-Amino-2-[2-(1-azido-3,6,9,12-tetraoxapentadecan-15-amido) ethanesulfonamido]hexanoic Acid (AL5)

(AL5)

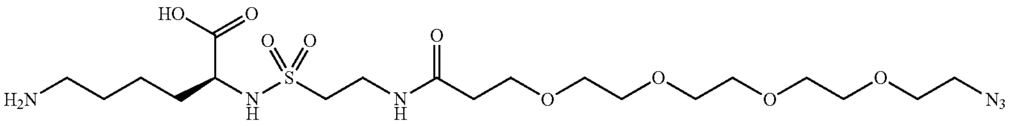

To a solution of compound AL5-6 (25 mg, 33 μmol) in ethanol (0.5 mL) was added aq. lithium hydroxide (0.33 M, 0.5 mL), and the reaction mixture was stirred at RT for 2 hours, which was monitored by LCMS. The reaction was quenched with aq. hydrochloride (1 M) to pH 7 and the resulting mixture was directly separated by reversed phase flash chromatography (0-100% acetonitrile in aq. formic acid (0.01%)) to give amino-azido linker AL5 (5.0 mg, 28% yield) as colorless oil. ESI m/z: 527.3 $(M+H)^+$. $^1H$ NMR (400 MHz, $DMSO_{d6}$) δ 8.20 (s, 1H), 7.90-7.80 (m, 2H), 7.50-7.40 (m, 1H), 3.80-3.10 (m, 27H), 3.10-3.05 (m, 1H), 2.80-2.75 (m, 1H), 2.35-2.30 (m, 1H), 1.80-1.50 (m, 2H), 1.45-1.40 (m, 1H) ppm. (Acid proton was not revealed. No aldehyde proton indicated that the linker was not formic acid salt form.)

Example 11: Synthesis of AL6 Linker

Amino-azido linker AL6 was synthesized as described in Scheme 15 and Examples 11A-11B, below.

Scheme 15: Synthesis of amino-azido linker AL6

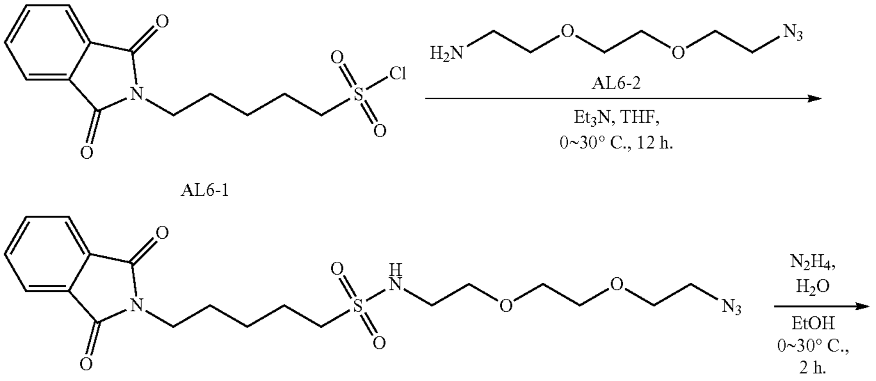

AL6-1

AL6-3

-continued

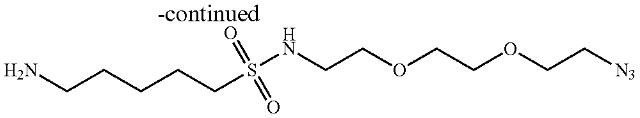

AL6

Example 11A: N-{2-[2-(2-Azidoethoxy)ethoxy]ethyl}-5-(1,3-dioxo-2,3-dihydro-1H-isoindol-2-yl)pentane-1-sulfonamide (AL6-3)

(AL6-3)

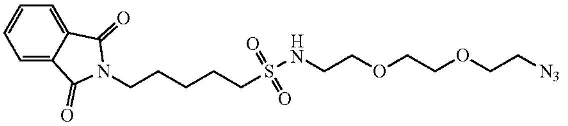

To a solution of amino-PEG$_2$-azide (AL6-2) (0.41 g, 2.4 mmol) in THF (30 mL) was added triethylamine (0.36 g, 3.6 mmol), followed by compound AL6-1 (0.83 g, 2.6 mmol, CAS: 63345-34-6) at 0° C. The reaction mixture was stirred at 30° C. for 12 hours, which was monitored by LCMS. The resulting mixture was concentrated in vacuo to give crude AL6-3 (0.91 g) as yellow oil, which was used for the next step without further purification. ESI m/z: 454.2 $(M+H)^+$.

Example 11B: 5-Amino-N-{2-[2-(2-azidoethoxy)ethoxy]ethyl}pentane-1-sulfonamide (AL6)

(AL6)

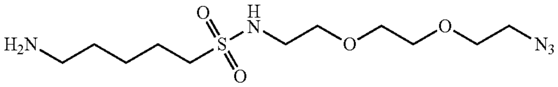

To a solution of compound AL6-3 (0.90 g, 1.9 mmol) in ethanol (10 mL) was added hydrazine hydrate (85%, 2.2 g, 38 mmol) at 0° C., and the reaction mixture was stirred at 30° C. for 2 hours, which was monitored by LCMS. The resulting mixture was concentrated in vacuo and the residue was purified by reversed phase flash chromatography (10-30% acetonitrile in aq. formic acid (0.225%)) to give amino-azido linker AL6 (0.18 g, 20% yield in 2 steps from AL6-2, formic acid salt) as a white solid. ESI m/z: 324.2 $(M+H)^+$. $^1$H NMR (400 MHz, DMSO$_{d6}$) δ 8.43 (br s, 1H), 3.63-3.58 (m, 2H), 3.57-3.51 (m, 4H), 3.45 (t, J=5.8 Hz, 2H), 3.41-3.36 (m, 2H), 3.08 (t, J=5.9 Hz, 2H), 3.03-2.95 (m, 2H), 2.75-2.64 (m, 2H), 1.69-1.57 (m, 2H), 1.56-1.46 (m, 2H), 1.44-1.33 (m, 2H) ppm.

Example 12: Synthesis of AL7 Linker

Amino-azido linker AL7 was synthesized as described in Scheme 16 and Examples 12A-12B, below.

Scheme 16: Synthesis of amino-azido linker AL7

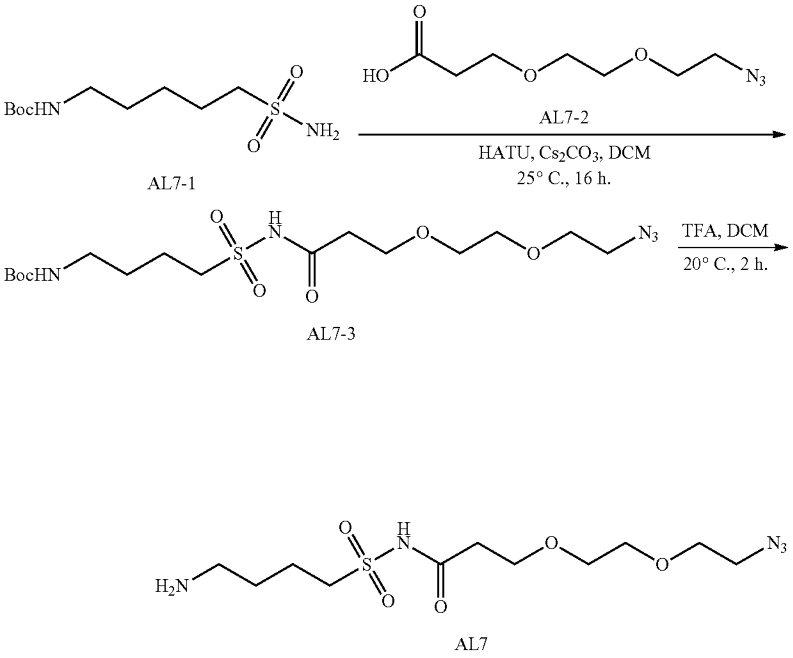

Example 12A: tert-Butyl N-[4-({3-[2-(2-azidoethoxy)ethoxy]propanamido}sulfonyl) butyl]carbamate (AL7-3)

(AL7-3)

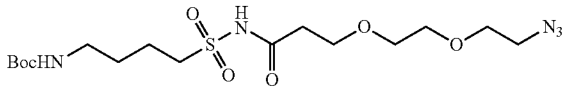

To a solution of compound AL7-2 (14 mg, 69 μmol, CAS: 1312309-63-9) in DCM (1.5 mL) was added HATU (29 mg, 76 μmol) at 25° C. The resulting mixture was stirred at 25° C. for 2 hours before the addition of cesium carbonate (49 mg, 0.15 mmol) and compound AL7-1 (21 mg, 83 μmol, CAS: 1862014-38-7). The reaction mixture was then stirred at 25° C. for 16 hours. Reaction completion was monitored by LCMS. The resulting mixture was diluted with DCM (8.0 mL) and quenched with water (4.0 mL). The two-phase mixture was acidified with aq. potassium bisulfate (0.5 M) to pH 5. The organic solution was separated and washed with water (4.0 mL) and brine (4.0 mL), dried over anhydrous sodium sulfate and concentrated in vacuo. The residue was purified by reversed phase flash chromatography (0-45% acetonitrile in aq. acetic acid (0.4%)) to give compound AL7-3 (15 mg, 45% yield) as a yellow solid. ESI m/z: 438.2 $(M+H)^+$. $^1H$ NMR (400 MHz, $CDCl_3$) δ 4.64 (brs, 1H), 3.82-3.76 (m, 2H), 3.75-3.66 (m, 6H), 3.51-3.41 (m, 4H), 3.16 (br d, J=6.9 Hz, 2H), 2.66-2.59 (m, 2H), 1.92-1.83 (m, 2H), 1.65 (quin, J=7.3 Hz, 2H), 1.45 (s, 9H) ppm.

Example 12B: N-(4-aminobutanesulfonyl)-3-[2-(2-azidoethoxy)ethoxy]propanamide (AL7)

(AL7)

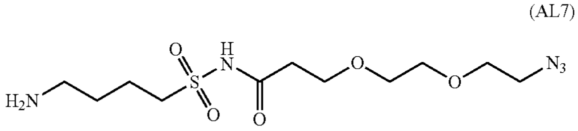 [SMILES: [N-]=[N+]=NCCOCCOCCC(=O)NS(=O)(=O)CCCCN]

To a solution of compound AL7-3 (8.0 mg, 18 μmol) in DCM (1.5 mL) was added TFA (0.3 μL, 4.1 μmol), and the reaction mixture was stirred at 20° C. for 2 hours until Boc was totally removed, which was monitored by LCMS. The resulting mixture was concentrated in vacuo and the residue was purified by reversed phase flash chromatography (8-28% acetonitrile in aq. formic acid (0.225%)) to give amino-azido linker AL7 (6.0 mg, 86% yield, formic acid salt) as a white solid. ESI m/z: 338.2 $(M+H)^+$. $^1H$ NMR (400 MHz, $DMSO_{d6}$) δ 3.63-3.59 (m, 2H), 3.57-3.53 (m, 4H), 3.51-3.46 (m, 4H), 2.97 (br s, 2H), 2.79 (br s, 2H), 2.20 (t, J=7.2 Hz, 2H), 1.60 (br s, 4H) ppm.

Example 13: Synthesis of AL8 Linker

Amino-azido linker AL8 was synthesized as described in Scheme 17 and Examples 13A-13C, below.

Scheme 17: Synthesis of amino-azido linker AL8

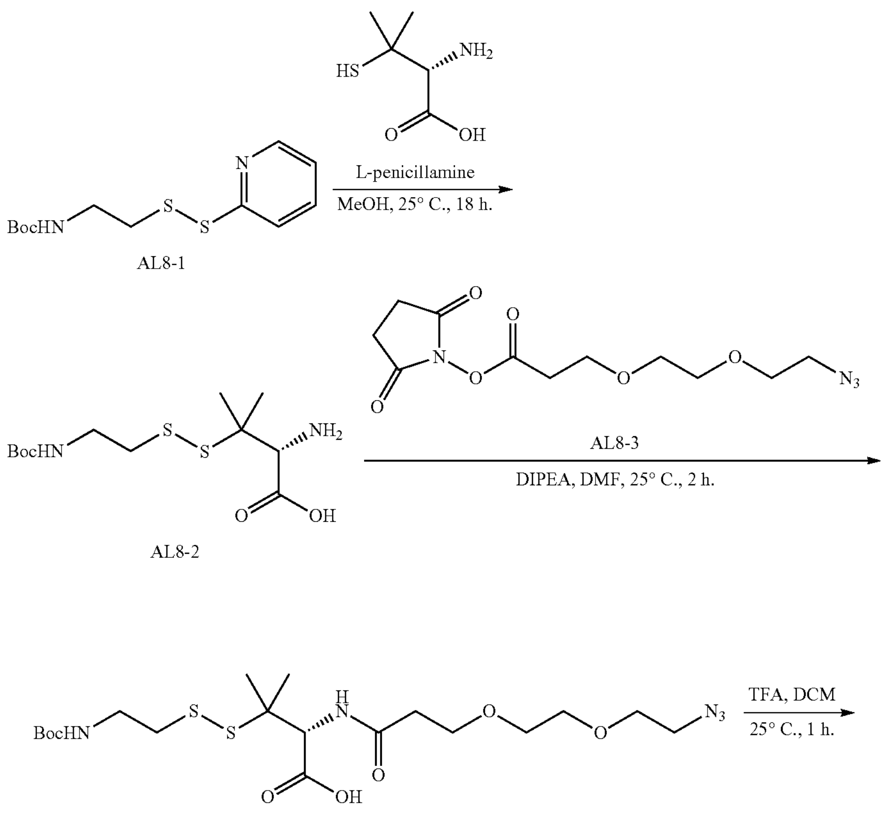

AL8-4

-continued

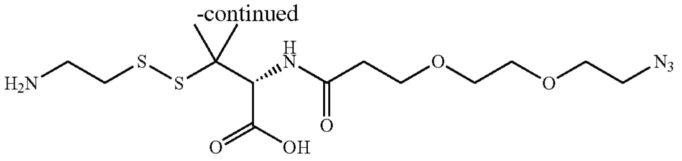

AL8

Example 13A: (2R)-2-Amino-3-[(2-{[(tert-butoxy) carbonyl]amino}ethyl)disulfanyl]-3-methylbutanoic Acid (AL8-2)

(AL8-2)

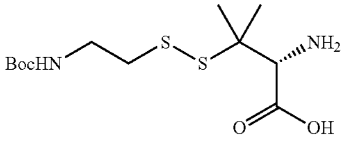

To a solution of compound AL8-1 (1.0 g, 1.8 mmol, CAS: 535943-48-7) in methanol (20 mL) was added L-penicillamine (0.78 g, 5.2 mmol, CAS: 1113-41-3), and the reaction mixture was stirred at 25° C. for 18 hours. Reaction completion was monitored by LCMS. The resulting mixture was concentrated in vacuo and the residue was purified by reversed phase flash chromatography (15-35% acetonitrile in aq. formic acid (0.225%)) to give compound AL8-2 (0.52 g, 80% yield, formic acid salt) as a white solid. $^1$H NMR (400 MHz, DMSO$_{d6}$) δ 6.97 (br t, J=5.6 Hz, 1H), 3.27 (s, 1H), 3.21-3.12 (m, 2H), 2.77 (t, J=6.9 Hz, 2H), 1.45 (s, 3H), 1.37 (s, 9H), 1.24 (s, 3H) ppm.

Example 13B: (2R)-2-{3-[2-(2-Azidoethoxy) ethoxy]propanamido}-3-[(2-{[(tert-butoxy)carbonyl] amino}ethyl)disulfanyl]-3-methylbutanoic acid (AL8-4)

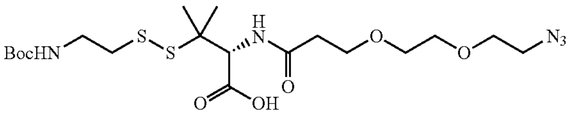 [SMILES: CC(C)(C)OC(=O)NCCSSC(C)(C)[C@H](NC(=O)CCOCCOCCN=[N+]=[N-])C(=O)O]

To a solution of compound AL8-2 (0.20 g, 0.54 mmol, formic acid salt) in DMF (2 mL) were added DIPEA (0.14 g, 1.1 mmol) and compound AL8-3 (0.20 g, 0.67 mmol, CAS: 1312309-64-0), and the reaction mixture was stirred at 25° C. for 2 hours. Reaction completion was monitored by LCMS. The resulting mixture was concentrated in vacuo, and the residue was purified by reversed phase flash chromatography (40-60% acetonitrile in aq. formic acid (0.225%)) to give compound AL8-4 (0.20 g, 73% yield) as colorless oil. $^1$H NMR (400 MHz, DMSO$_{d6}$) δ 8.20-8.07 (m, 1H), 6.91 (br t, J=5.4 Hz, 1H), 4.50 (d, J=9.0 Hz, 1H), 3.63-3.57 (m, 4H), 3.56-3.52 (m, 2H), 3.51-3.48 (m, 2H), 3.39 (br s, 2H), 3.18-3.12 (m, 2H), 2.79-2.67 (m, 2H), 2.48-2.36 (m, 2H), 1.37 (s, 9H), 1.35 (s, 3H), 1.29 (s, 3H) ppm.

Example 13C: (2R)-3-[(2-Aminoethyl)disulfanyl]-2-{3-[2-(2-azidoethoxy)ethoxy]propanamido}-3-methylbutanoic Acid (AL8)

(AL8)

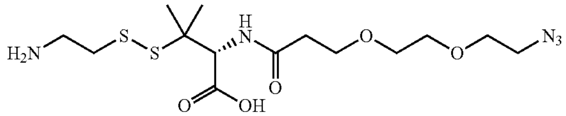

To a solution of compound AL8-4 (0.25 g, 0.49 mmol) in DCM (2.0 mL) was added TFA (2.0 mL), and the reaction mixture was stirred at 25° C. for an hour, which was monitored by TLC. The mixture was concentrated in vacuo to give crude linker AL8 (0.20 g) as a TFA salt. The crude salt (45 mg, 86 μmol) was dissolved in mixture of solvent of DMF (1 mL) and methanol (1 mL) and the resulting solution was subjected to reversed phase flash chromatography (12-32% acetonitrile in aq. ammonia (0.05%)) to provide AL8 (12 mg, 33% yield, ammonium salt) as a white solid. ESI m/z: 410.2 $(M+H)^+$. $^1$H NMR (400 MHz, $D_2O$) δ 4.44 (s, 1H), 3.82 (t, J=5.7 Hz, 2H), 3.76-3.65 (m, 6H), 3.55-3.47 (m, 2H), 3.36 (t, J=6.4 Hz, 2H), 3.09-2.95 (m, 2H), 2.71-2.54 (m, 2H), 1.46 (s, 3H), 1.41 (s, 3H) ppm.

$^1$H NMR (400 MHz, DMSO$_{d6}$) for AL8 TFA salt: δ 8.25-8.16 (m, 1H), 7.88 (br s, 3H), 4.56 (d, J=9.3 Hz, 1H), 3.63-3.48 (m, 8H), 3.43-3.36 (m, 2H), 3.12-3.00 (m, 2H), 2.93-2.87 (m, 2H), 2.47-2.38 (m, 2H), 1.37 (s, 3H), 1.31 (s, 3H) ppm.

Example 14: Synthesis of AL9 Linker

Amino-azido linker AL9 was synthesized as described in Scheme 18 and Examples 14A-14C, below.

Scheme 18: Synthesis of amino-azido linker AL9
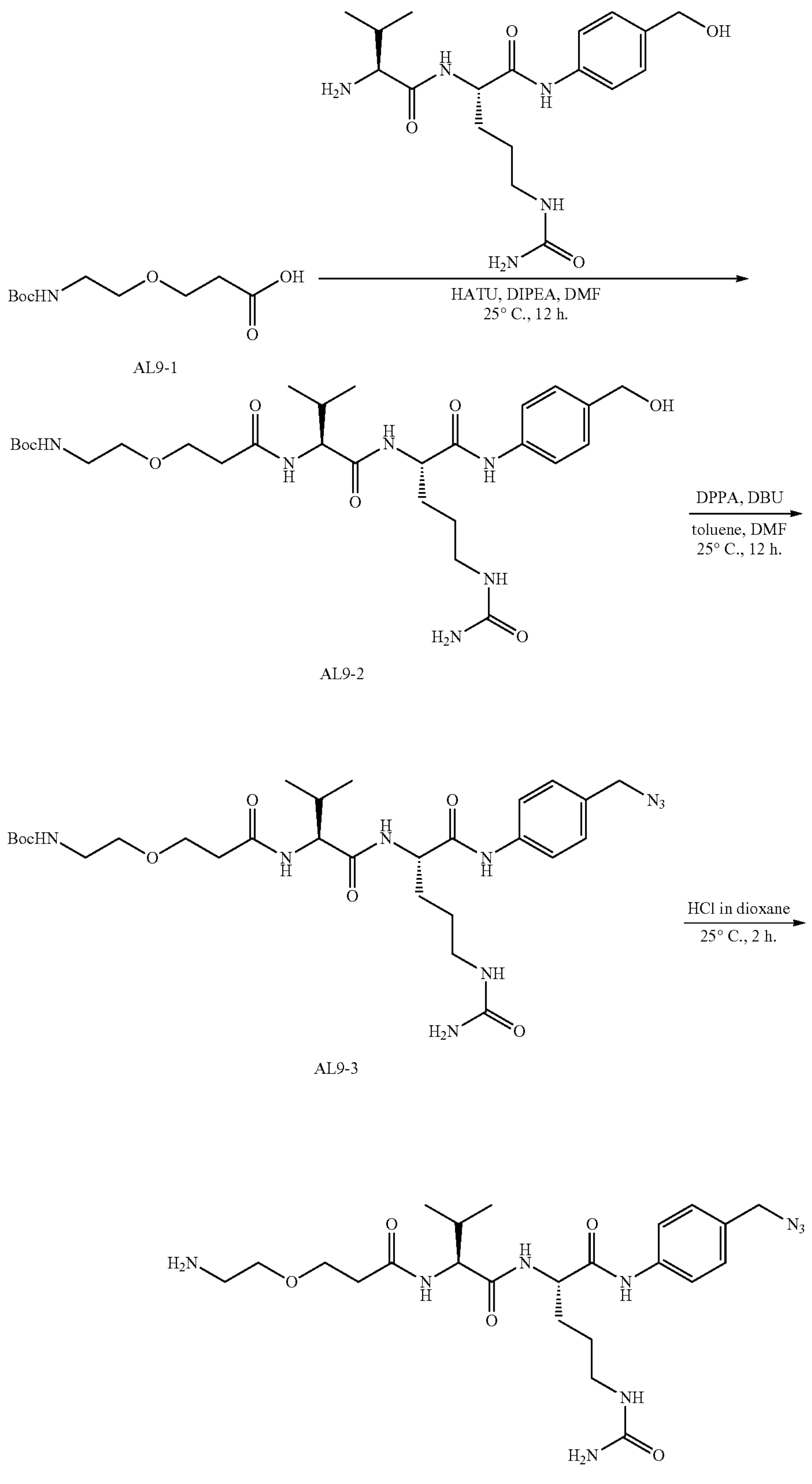
AL9-1
AL9-2
AL9-3
AL9

Example 14A: tert-Butyl N-[2-(2-{[(1S)-1-{[(1S)-4-(carbamoylamino)-1-{[4-(hydroxymethyl)phenyl]carbamoyl}butyl]carbamoyl}-2-methylpropyl]carbamoyl}ethoxy)ethyl]carbamate (AL9-2)

(AL9-2)

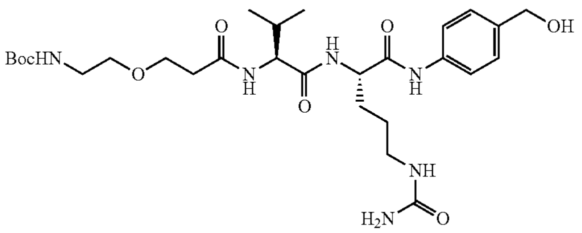

To a solution of vcPAB (0.60 g, 1.6 mmol, CAS: 159857-79-1) in DMF (5 mL) were added HATU (0.60 g, 1.6 mmol), DIPEA (0.61 g, 4.7 mmol) and AL9-1 (0.41 g, 1.7 mmol, CAS: 1260092-44-1), and the reaction mixture was stirred at 25° C. for 12 hours. Reaction completion was monitored by LCMS. The mixture was concentrated in vacuo and the residue was purified by reversed phase flash chromatography (0-35% acetonitrile in water) to give compound AL9-2 (0.85 g, 86% yield) as a white solid. ESI m/z: 495.3 $(M-Boc+H)^+$. $^1H$ NMR (400 MHz, $DMSO_{d6}$) δ 9.89 (s, 1H), 8.10 (d, J=7.4 Hz, 1H), 7.86 (d, J=8.5 Hz, 1H), 7.54 (d, J=8.4 Hz, 2H), 7.22 (d, J=8.4 Hz, 2H), 6.70 (br s, 1H), 6.02-5.91 (m, 1H), 5.40 (s, 2H), 5.08 (t, J=5.6 Hz, 1H), 4.42 (d, J=5.4 Hz, 2H), 4.26-4.20 (m, 1H), 3.62-3.53 (m, 3H), 3.07-2.88 (m, 6H), 2.03-1.91 (m, 1H), 1.68 (br d, J=8.9 Hz, 1H), 1.63-1.50 (m, 1H), 1.36 (s, 13H), 0.86 (d, J=6.8 Hz, 3H), 0.82 (d, J=6.8 Hz, 3H) ppm.

Example 14B: tert-Butyl N-[2-(2-{[(1S)-1-{[(1S)-1-{[4-(azidomethyl)phenyl]carbamoyl}-4-(carbamoylamino)butyl]carbamoyl}-2-methylpropyl]carbamoyl}ethoxy)ethyl]carbamate (AL9-3)

(AL9-3)

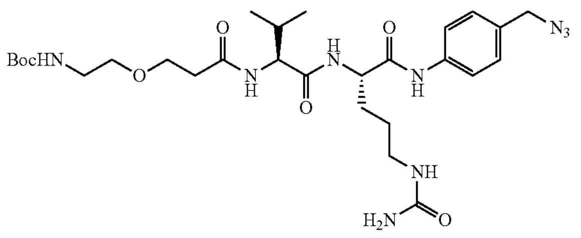

To a solution of compound AL9-2 (0.40 g, 0.67 mmol) in toluene (18 mL) and DMF (2 mL) were added DBU (0.26 g, 1.7 mmol) and DPPA (0.46 g, 1.7 mmol). The mixture was stirred at 25° C. for 12 hours. Reaction completion was monitored by LCMS. The resulting mixture was concentrated in vacuo and the residue was purified by flash silica gel chromatography (0-12% methanol in DCM) to give compound AL9-3 (0.32 g, 61% yield) as a white solid. $^1H$ NMR (400 MHz, $DMSO_{d6}$) δ 10.03 (s, 1H), 8.14 (br d, J=6.8 Hz, 1H), 7.87 (br d, J=8.8 Hz, 1H), 7.63 (d, J=8.5 Hz, 2H), 7.31 (d, J=8.4 Hz, 2H), 6.78-6.66 (m, 1H), 6.02-5.93 (m, 1H), 5.41 (s, 2H), 4.37 (s, 2H), 4.24 (br t, J=7.6 Hz, 1H), 3.63-3.52 (m, 3H), 3.08-2.88 (m, 6H), 2.01-1.92 (m, 1H), 1.72-1.65 (m, 1H), 1.65-1.59 (m, 1H), 1.36 (s, 13H), 0.86 (br d, J=6.8 Hz, 3H), 0.83 (br d, J=6.6 Hz, 3H) ppm.

Example 14C: (2S)-2-[(2S)-2-[3-(2-Aminoethoxy)propanamido]-3-methylbutanamido]-N-[4-(azidomethyl)phenyl]-5-(carbamoylamino)pentanamide (AL9)

(AL9)

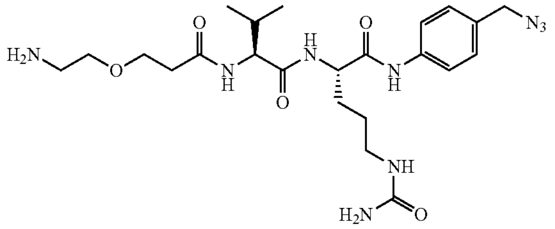

To a solution of hydrochloride in dioxane (4 N, 5 mL) was added compound AL9-3 (0.17 g, 0.21 mmol), and the resulting solution was stirred at 25° C. for 2 hours until Boc was totally removed, which was monitored by LCMS. The mixture was directly purified by reversed phase flash chromatography (34-74% acetonitrile in aq. ammonia (0.05%)) to give linker AL9 (68 mg, 61% yield) as a white solid. ESI m/z: 520.3 $(M+H)^+$. $^1H$ NMR (400 MHz, $DMSO_{d6}$) δ 10.04 (s, 1H), 8.16 (br d, J=7.4 Hz, 1H), 7.90 (br d, J=8.4 Hz, 1H), 7.63 (d, J=8.5 Hz, 2H), 7.31 (d, J=8.5 Hz, 2H), 6.06-5.94 (m, 1H), 5.42 (s, 2H), 4.44-4.33 (m, 3H), 4.24 (br dd, J=6.8, 8.6 Hz, 1H), 3.65-3.54 (m, 2H), 3.07-2.90 (m, 2H), 2.68-2.65 (m, 2H), 2.46-2.34 (m, 4H), 2.00-1.93 (m, 1H), 1.81-1.21 (m, 6H), 0.86 (d, J=6.8 Hz, 3H), 0.83 (d, J=6.8 Hz, 3H) ppm.

Example 15: Synthesis of Branched Linkers BL1 and BL2

Branched linkers BL1 and BL2 were synthesized as described in Scheme 19 and Examples 15A-15F, below.

Scheme 19: Synthesis of branched linkers BL1 and BL2

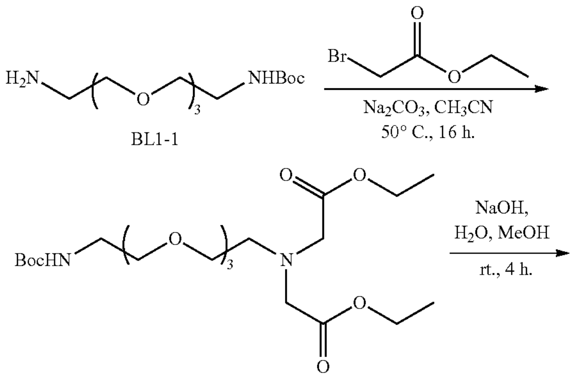

BL1-1

BL1-2

-continued

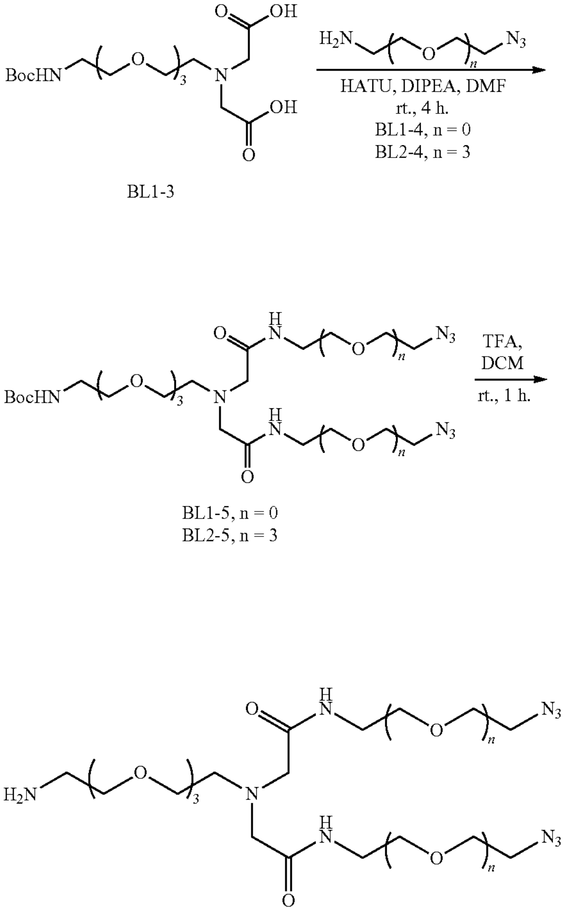

BL1-3

BL1-5, n = 0
BL2-5, n = 3

BL1, n = 0
BL2, n = 3

Example 15A: Ethyl 1-{[(tert-butoxy)carbonyl] amino}-12-(2-ethoxy-2-oxoethyl)-3,6,9-trioxa-12-azatetradecan-14-oate (BL1-2)

(BL1-2)

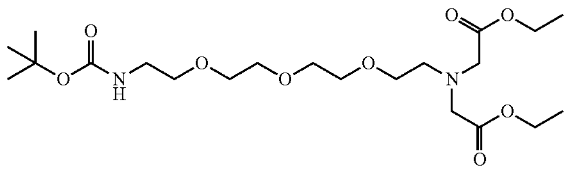

To a solution of compound BL1-1 (CAS: 101187-40-0) (0.29 g, 1.0 mmol) in acetonitrile (50 mL) were added ethyl bromoacetate (0.37 g, 2.2 mmol) and sodium carbonate (0.27 g, 2.5 mmol), and the reaction mixture was stirred at 50° C. for 16 hours. Reaction completion was monitored by TLC ($R_f$=0.6, 10% methanol in DCM). After cooling to RT, the mixture was filtered and the filtrate was concentrated in vacuo to give crude product BL1-2 (0.40 g, 86% crude yield) as a yellow oil, which was used for the next step without further purification. ESI m/z: 465.1 $(M+H)^+$.

Example 15B: 1-{[(tert-Butoxy)carbonyl]amino}-12-(carboxymethyl)-3,6,9-trioxa-12-azatetradecan-14-oic Acid (BL1-3)

(BL1-3)

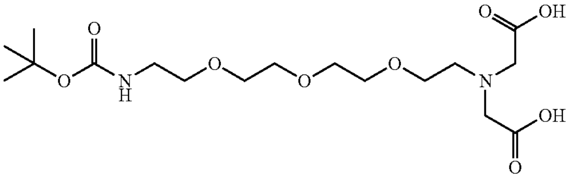

To a solution of crude compound BL1-2 (0.23 g, 0.50 mmol, obtained above) in methanol (5 mL) was added aq. sodium hydroxide (2 M, 5 mL). The reaction mixture was stirred at RT for 4 hours. The methanol was removed in vacuo and the residual aqueous solution was acidified to pH 3 with aq. hydrochloride (1 N). The resulting mixture was extracted with DCM (10 mL×3) and the combined organic solution was dried over anhydrous sodium sulfate and concentrated in vacuo to give crude product BL1-3 (81 mg, 40% yield) as a colorless oil. ESI m/z: 409.1 $(M+H)^+$. $^1$H NMR (400 MHz, $DMSO_{d6}$) δ 3.55-3.35 (m, 17H), 3.08-3.06 (m, 4H), 1.37 (s, 9H) ppm.

Example 15C: tert-Butyl N-{1-[(2-azidoethyl)carbamoyl]-2-{[(2-azidoethyl) carbamoyl]methyl}-5,8,11-trioxa-2-azatridecan-13-yl}carbamate (BL1-5)

(BL1-5)

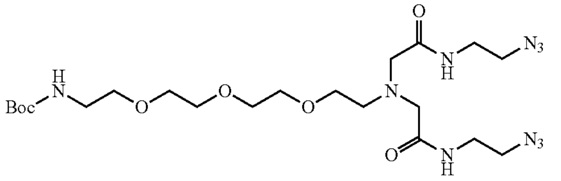

To a solution of compound BL1-3 (75 mg, 0.18 mmol) and 2-azidoethanamine BL1-4 (47 mg, 0.55 mmol) in DMF (5 mL) were added HATU (0.21 g, 0.55 mmol) and DIPEA (0.14 g, 1.1 mmol), and the reaction mixture was stirred at RT for 4 hours, which was monitored by LCMS. The resulting mixture was directly reversed phase flash chromatography (30-90% acetonitrile in aq. ammonium bicarbonate (10 mM)) to give compound BL1-5 (63 mg, 64% yield) as colorless oil. ESI m/z: 545.3 $(M+H)^+$.

Example 15D: 1-Amino-N-(2-azidoethyl)-12-{[(2-azidoethyl)carbamoyl]methyl}-3,6,9-trioxa-12-aza-tetradecan-14-amide, TFA salt (BL1)

(BL1)

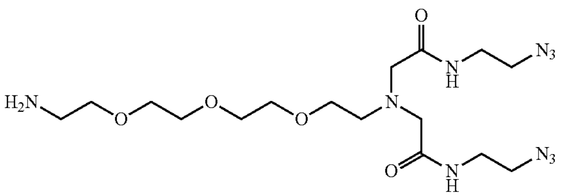

To a solution of compound BL1-5 (0.10 g, 0.18 mmol) in DCM (10 mL) was added TFA (3 mL), and the reaction mixture was stirred at RT for an hour. The volatiles were removed in vacuo and the residue was purified by reversed phase flash chromatography (0-100% acetonitrile in aq. TFA (0.01%)) to give branched linker BL1 (25 mg, 31% yield, TFA salt) as a colorless oil. ESI m/z: 445.2 $(M+H)^+$. $^1H$ NMR (500 MHz, $DMSO_{d6}$) δ 8.48 (br s, 2H), 7.88 (br s, 3H), 3.63-3.50 (m, 16H), 3.42-3.38 (m, 4H), 3.34-3.28 (m, 4H), 3.05-2.95 (m, 4H) ppm.

Example 15E: tert-Butyl N-{1-[(2-{2-[2-(2-azido-ethoxy)ethoxy]ethoxy}ethyl) carbamoyl]-2-{[(2-{2-[2-(2-azidoethoxy)ethoxy]ethoxy}ethyl) carbamoyl] methyl}-5,8,11-trioxa-2-azatridecan-13-yl}carbamate (BL2-5)

(BL2-5)

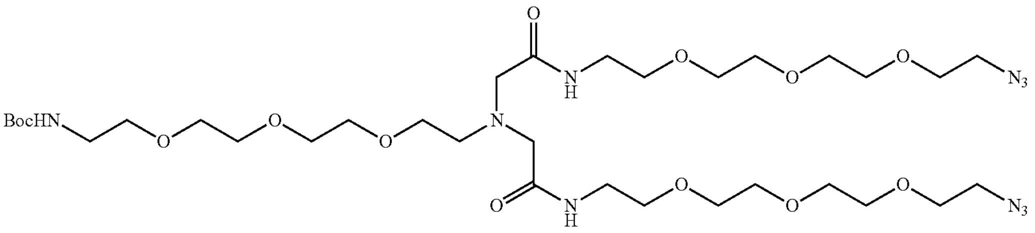

Following the similar procedure as compound BL1-5 except substituting BL2-4 for BL1-4, compound BL2-5 (0.27 g, 74% yield) was obtained as a colorless oil. ESI m/z: 809.5 $(M+H)^+$.

Example 15F: 1-Amino-N-(2-{2-[2-(2-azidoethoxy) ethoxy]ethoxy}ethyl)-12-{[(2-{2-[2-(2-azidoethoxy) ethoxy]ethoxy}ethyl)carbamoyl]methyl}-3,6,9-tri-oxa-12-azatetradecan-14-amide (BL2)

(BL2)

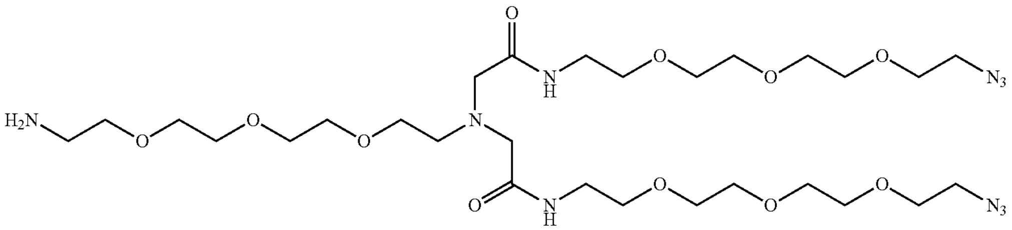

Following the similar procedure as BL1 except substituting BL2-5 for BL1-5, branched linker BL2 (94 mg, 39% yield) was obtained as a colorless oil after purification by reversed phase flash chromatography (0-100% acetonitrile in aq. ammonium bicarbonate (10 mM)). ESI m/z: 709.5 $(M+H)^+$. $^1H$ NMR (400 MHz, $DMSO_{d6}$) δ 8.02 (t, J=5.6 Hz, 2H), 3.60 (t, J=4.4 Hz, 4H), 3.57-3.45 (m, 26H), 3.45-3.37 (m, 8H), 3.34 (t, J=6.0 Hz, 2H), 3.28-3.20 (m, 4H), 3.15 (s, 4H), 2.70-2.60 (m, 4H) ppm.

Example 16: Synthesis of Branched Linker BL3

Branched linker BL3 was synthesized as described in Scheme 20 and Examples 16A-16D, below.

Scheme 20: Synthesis of amino-azido linker BL3

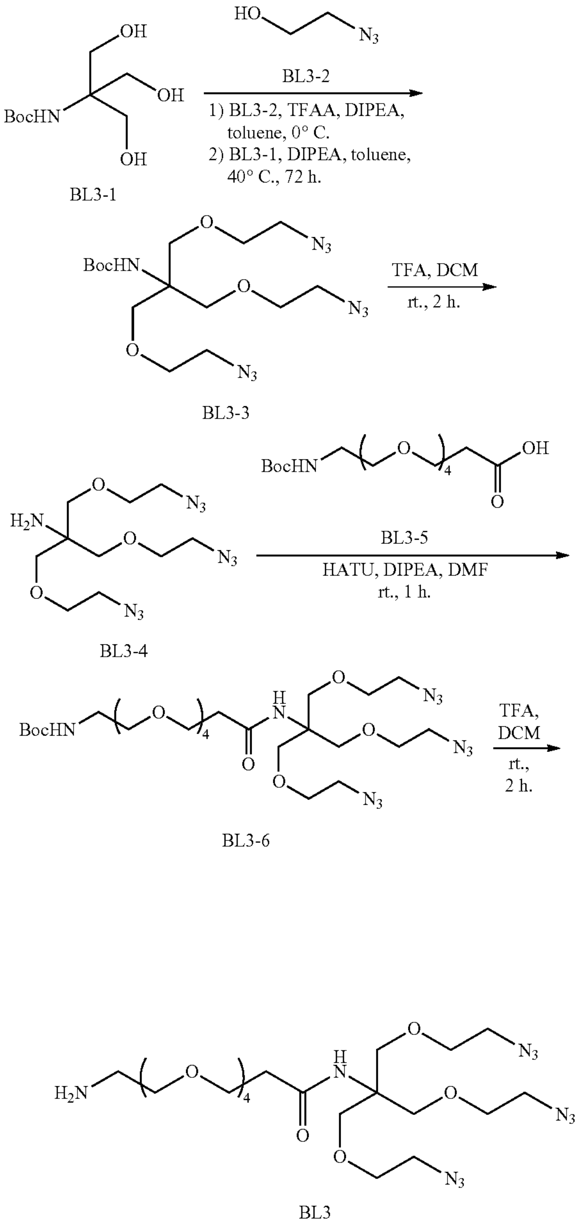

Example 16A: tert-Butyl N-[1,3-bis(2-azidoethoxy)-2-[(2-azidoethoxy)methyl]propan-2-yl]carbamate (BL3-3)

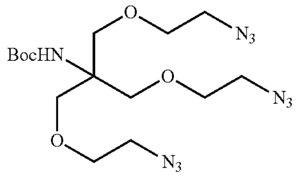

(BL3-3)

To a solution of 2-azidoethanol (BL3-2) (1.1 g, 13 mmol) in toluene (6 mL) were added DIPEA (1.9 g, 15 mmol) and TFAA (3.7 g, 13 mmol) at −2° C. to 2° C., and the reaction mixture was stirred at 0° C. for 2 hours. To the resulting mixture were added DIPEA (1.9 g, 15 mmol), toluene (6 mL) and compound BL3-1 (CAS: 146651-71-0) (0.24 g, 1.1 mmol), and the reaction mixture was stirred at 40° C. for 72 hours. The reaction was then quenched with pyridine (0.2 mL) and diluted with ethyl acetate (100 mL). The organic solution was washed with aq. citric acid (1 M), aq. sodium bicarbonate (10%), water and brine, dried over anhydrous sodium sulfate and concentrated in vacuo. The residue was purified by reversed phase flash chromatography (0-100% acetonitrile in aq. ammonium bicarbonate (10 mM)) to give compound BL3-3 (30 mg, 6.4% yield) as colorless oil. ESI m/z: 451.0 $(M+Na)^+$. $^1$HNMR (500 MHz, $CDCl_3$) δ 3.78 (s, 6H), 3.66 (t, J=5.0 Hz, 6H), 3.34 (t, J=5.0 Hz, 6H), 1.43 (s, 9H) ppm.

Example 16B: 1,3-Bis(2-azidoethoxy)-2-[(2-azidoethoxy)methyl]propan-2-amine (BL3-4)

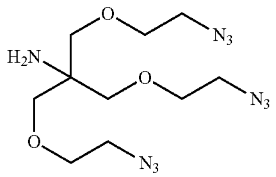

(BL3-4)

To a solution of compound BL3-3 (56 mg, 0.13 mmol) in DCM (4 mL) was added TFA (1 mL), and the reaction mixture was stirred at RT for 2 hours until Boc was totally removed, which was monitored by LCMS. The mixture was concentrated in vacuo to give crude compound BL3-4 (43 mg, 100% crude yield) as yellow oil, which was used for the next step without further purification. ESI m/z: 329.1 $(M+H)^+$.

Example 16C: tert-Butyl N-(14-{[1,3-bis(2-azido-ethoxy)-2-[(2-azidoethoxy)methyl]propan-2-yl]carbamoyl}-3,6,9,12-tetraoxatetradecan-1-yl)carbamate (BL3-6)

(BL3-6)

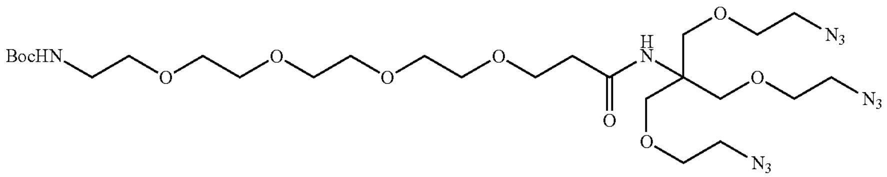

To a solution of compound BL3-5 (53 mg, 0.14 mmol) in DMF (3 mL) was added HATU (69 mg, 0.18 mmol), and the mixture was stirred at RT for 5 minutes. To the stirred solution were added a solution of crude compound BL3-4 (43 mg), which was obtained above, in DMF (1 mL) and DIPEA (50 mg, 0.39 mmol) successively. The resulting mixture was stirred at RT for an hour. Reaction completion was monitored by LCMS. The reaction solution was directly purified by reversed phase flash chromatography (0-100% acetonitrile in aq. ammonium bicarbonate (10 mM)) to give compound BL3-6 (65 mg, 73% yield in 2 steps) as a colorless oil. ESI m/z: 676.4 $(M+H)^+$.

Example 16D: 1-Amino-N-[1,3-bis(2-azidoethoxy)-2-[(2-azidoethoxy) methyl]propan-2-yl]-3,6,9,12-tetraoxapentadecan-15-amide (BL3)

(BL3)

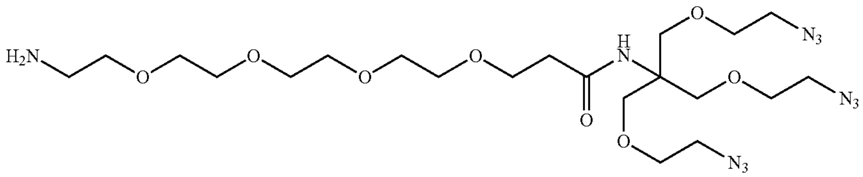

To a solution of compound BL3-6 (65 mg, 96 μmol) in DCM (4 mL) was added TFA (1 mL), and the reaction mixture was stirred at RT for 2 hours until Boc was totally removed, which was monitored by LCMS. The volatiles were removed in vacuo and the residue was purified by reversed phase flash chromatography (0-100% acetonitrile in aq. ammonium bicarbonate (10 mM)) to give branched linker BL3 (44 mg, 79% yield) as colorless oil. ESI m/z: 576.3 $(M+H)^+$. $^1H$ NMR (500 MHz, $DMSO_{d6}$) δ 7.25 (s, 1H), 3.69 (s, 6H), 3.56-3.60 (m, 8H), 3.47-3.52 (m, 12H), 3.44 (t, J=5.5 Hz, 4H), 3.35-3.37 (m, 6H), 2.76 (t, J=5.5 Hz, 2H), 2.35 (t, J=6.5 Hz, 2H) ppm.

Example 17: Synthesis of Branched Linkers BL4, BL5 and BL6

Branched linkers BL4, BL5 and BL6 were synthesized as described in Scheme 21 and Examples 17A-17H, below.

Scheme 21: Synthesis of amino-azido linkers BL4, BL5 and BL6

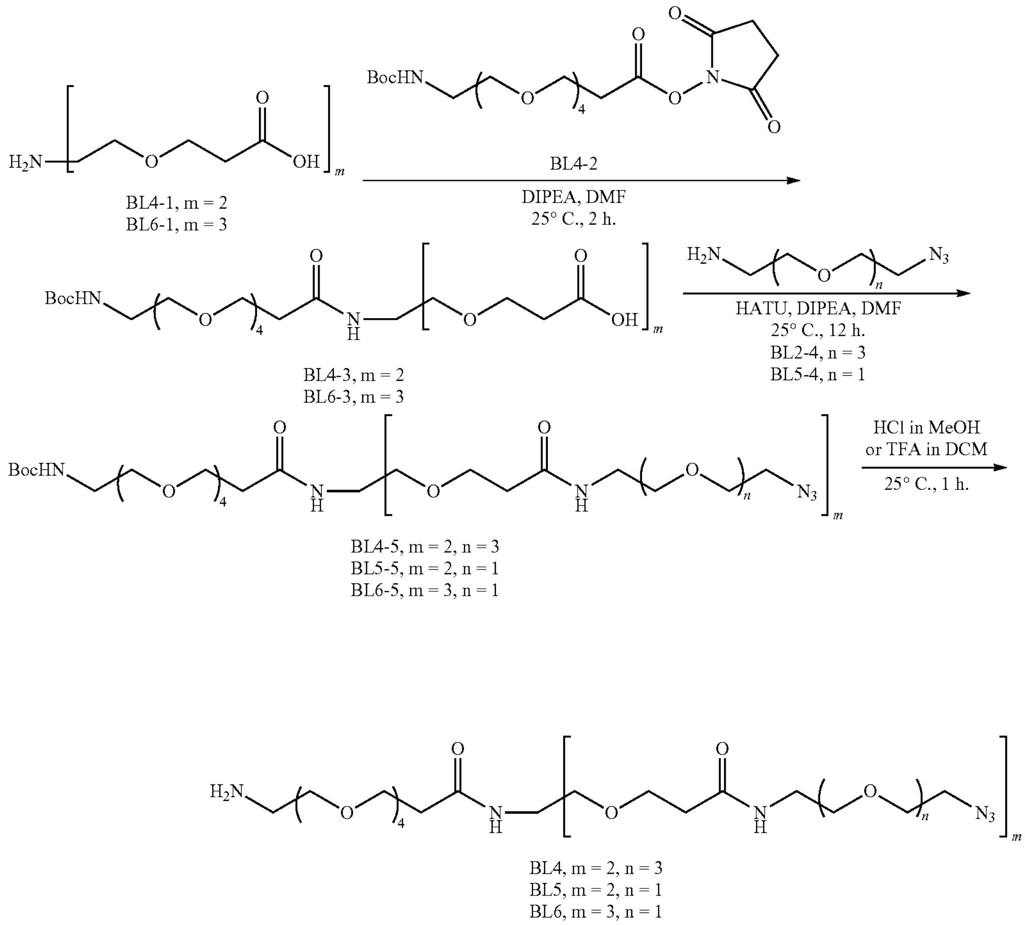

Example 17A: 3-[2-(1-{[(tert-Butoxy)carbonyl]amino}-3,6,9,12-tetraoxapentadecan-15-amido)-3-(2-carboxyethoxy)propoxy]propanoic Acid (BL4-3)

(BL4-3)

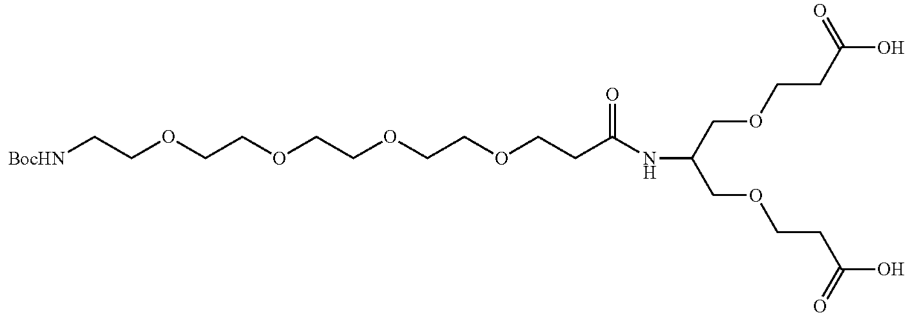

To a solution of compound BL4-1 (0.15 g, 0.64 mmol, CAS: 1020112-73-5) in DMF (5 mL) were added DIPEA (0.16 g, 1.3 mmol) and Boc-N-amido-PEG4-NHS ester (BL4-2) (0.37 g, 0.80 mmol, CAS: 859230-20-9), and the reaction mixture was stirred at 25° C. for an hour, Reaction completion was monitored by LCMS. The reaction mixture was concentrated in vacuo and the residue was purified by prep-HPLC (20-40% acetonitrile in aq. ammonia hydroxide (0.05% vol.)) to give compound BL4-3 (0.15 g, 39% yield) as a colorless oil. ESI m/z: 605.2 $(M+Na)^+$. $^1$H NMR (400 MHz, $DMSO_{d6}$) δ 7.71 (d, J=8.1 Hz, 1H), 6.75 (br s, 1H), 4.01-3.88 (m, 1H), 3.58 (t, J=6.3 Hz, 6H), 3.52-3.44 (m, 14H), 3.39-3.36 (m, 4H), 3.09-3.02 (m, 2H), 2.43 (t, J=6.3 Hz, 3H), 2.32 (t, J=6.4 Hz, 2H), 1.37 (s, 9H) ppm.

Example 17B: tert-Butyl N-(14-{[1,3-bis({2-[(2-{2-[2-(2-azidoethoxy)ethoxy]ethoxy}ethyl)carbamoyl]ethoxy})propan-2-yl]carbamoyl}-3,6,9,12-tetraoxa-tetradecan-1-yl)carbamate (BL4-5)

(BL4-5)

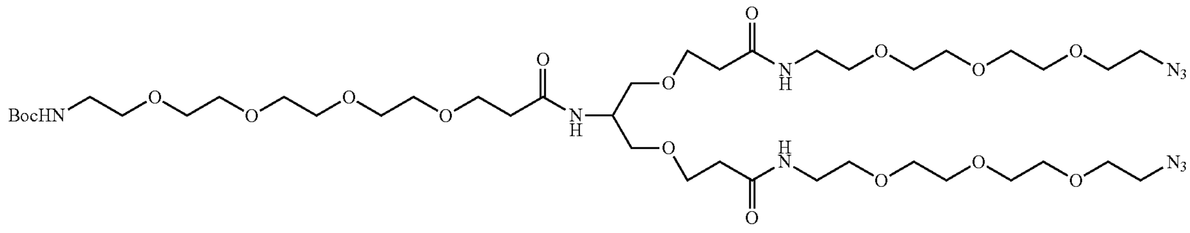

To a solution of compound BL4-3 (75 mg, 0.13 mmol) in DMF (2 mL) were added DIPEA (0.10 g, 0.77 mmol), HATU (0.15 g, 0.39 mmol) and compound BL2-4 (70 mg, 0.32 mmol), and the reaction mixture was stirred at 25° C. for 12 hours. Reaction completion was monitored by LCMS. The resulting mixture was concentrated in vacuo and the residue was purified by prep-HPLC (33-53% acetonitrile in aq. formic acid (0.225%)) to give compound BL4-5 (50 mg, 40% yield) as a colorless oil. ESI m/z: 983.6 $(M+H)^+$. $^1H$ NMR (400 MHz, $MeOD_{d4}$) δ 4.13 (quin, J=5.4 Hz, 2H), 3.76-3.68 (m, 12H), 3.66-3.58 (m, 19H), 3.56-3.46 (m, 12H), 3.22 (t, J=5.6 Hz, 4H), 2.54 (t, J=6.1 Hz, 8H), 2.47 (t, J=6.3 Hz, 4H), 1.44 (s, 13H) ppm.

Example 17C: 1-Amino-N-[1,3-bis({2-[(2-{2-[2-(2-azidoethoxy)ethoxy]ethoxy}ethyl)carbamoyl]ethoxy})propan-2-yl]-3,6,9,12-tetraoxapentadecan-15-amide (BL4)

(BL4)

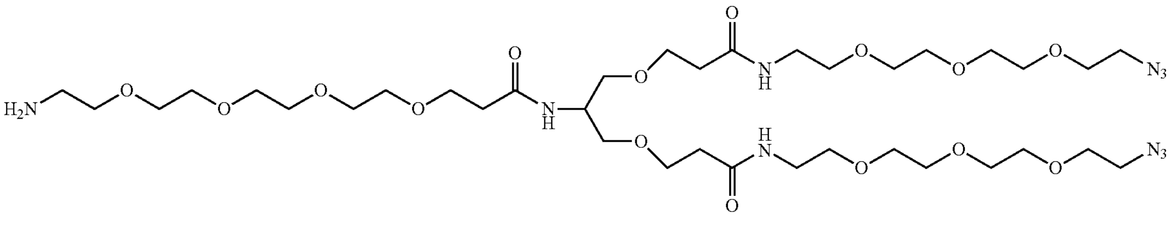

A mixture of compound BL4-5 (30 mg, 31 μmol) in a solution of hydrochloride in methanol (4 M, 5 mL) was stirred at 25° C. for an hour until Boc was totally removed, which was monitored by TLC (eluted by ethyl acetate). The reaction mixture was then concentrated in vacuo and the residue was purified by prep-HPLC (35-55% acetonitrile in aq. ammonia hydroxide (0.05%)) to give branched linker BL4 (15 mg, 33% yield) as a colorless oil. ESI m/z: 883.5 $(M+H)^+$. $^1H$ NMR (400 MHz, $MeOD_{d4}$) δ 4.17-4.08 (m, 2H), 3.80-3.69 (m, 20H), 3.67-3.61 (m, 19H), 3.52-3.44 (m, 8H), 3.15 (br d, J=4.3 Hz, 4H), 2.58 (t, J=6.0 Hz, 8H), 2.49 (t, J=5.9 Hz, 4H) ppm.

Example 17D: tert-Butyl N-(14-{[1,3-bis(2-{[2-(2-azidoethoxy)ethyl]carbamoyl}ethoxy)propan-2-yl]carbamoyl}-3,6,9,12-tetraoxatetradecan-1-yl)carbamate (BL5-5)

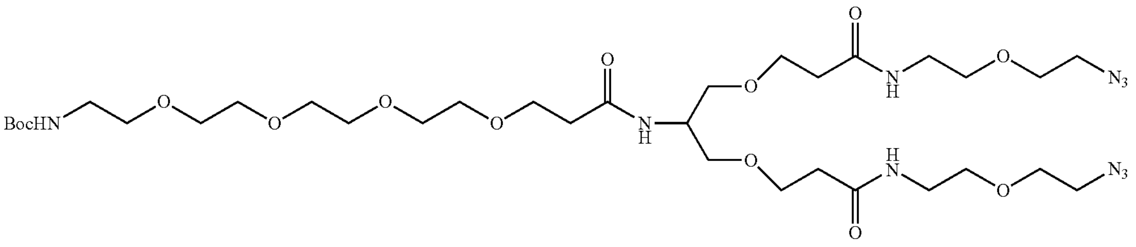 [SMILES: CC(C)(C)OC(=O)NCCOCCOCCOCCOCCC(=O)NC(COCCC(=O)NCCOCCN=[N+]=[N-])COCCC(=O)NCCOCCN=[N+]=[N-]]

Following the similar procedure of BL4-5 except substituting BL5-4 for BL2-4, compound BL5-5 (0.10 g, 61% yield) was obtained as a colorless oil. ESI m/z: 807.5 $(M+H)^+$. $^1$H NMR (400 MHz, $DMSO_{d6}$) δ 7.90 (t, J=5.5 Hz, 2H), 7.72 (d, J=8.3 Hz, 1H), 6.78-6.70 (m, 1H), 3.96-3.88 (m, 1H), 3.62-3.54 (m, 10H), 3.52-3.42 (m, 16H), 3.41-3.35 (m, 10H), 3.26-3.18 (m, 4H), 3.10-3.02 (m, 2H), 2.38-2.27 (m, 6H), 1.37 (s, 9H) ppm.

Example 17E: 1-Amino-N-[1,3-bis(2-{[2-(2-azidoethoxy)ethyl]carbamoyl}ethoxy) propan-2-yl]-3,6,9,12-tetraoxapentadecan-15-amide (BL5)

(BL5)

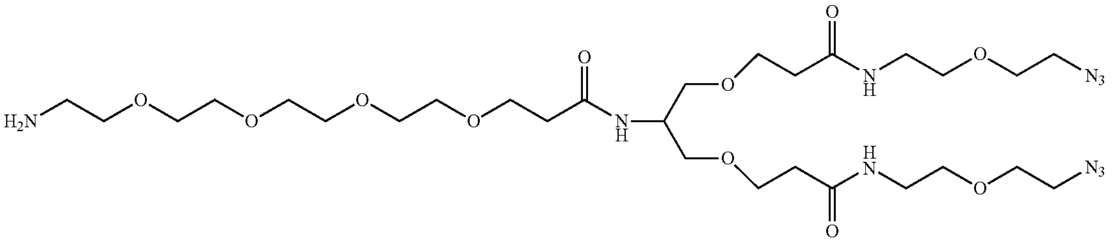

To a solution of compound BL5-5 (0.10 g, 0.12 mmol) in DCM (2 mL) was added TFA (2 mL). The mixture was stirred at 25° C. for an hour. Reaction completion was monitored by TLC (eluted with ethyl acetate). The resulting mixture was concentrated in vacuo and the residue was purified by prep-HPLC (35-55% acetonitrile in aq. ammonia (0.05%)) to give branched linker BL5 (40 mg, 45% yield) as a colorless oil. ESI m/z: 707.5 $(M+H)^+$. $^1$H NMR (400 MHz, $CDCl_3$) δ 6.98 (br d, J=8.0 Hz, 1H), 6.64 (br s, 2H), 4.22 (td, J=4.6, 8.8 Hz, 1H), 3.80-3.37 (m, 40H), 2.89 (t, J=5.1 Hz, 2H), 2.51 (t, J=6.0 Hz, 2H), 2.45 (t, J=5.9 Hz, 4H) ppm.

Example 17F: 3-[2-(1-{[(tert-Butoxy)carbonyl]amino}-3,6,9,12-tetraoxapentadecan-15-amido)-3-(2-carboxyethoxy)-2-[(2-carboxyethoxy)methyl]propoxy]propanoic Acid (BL6-3)

(BL6-3)

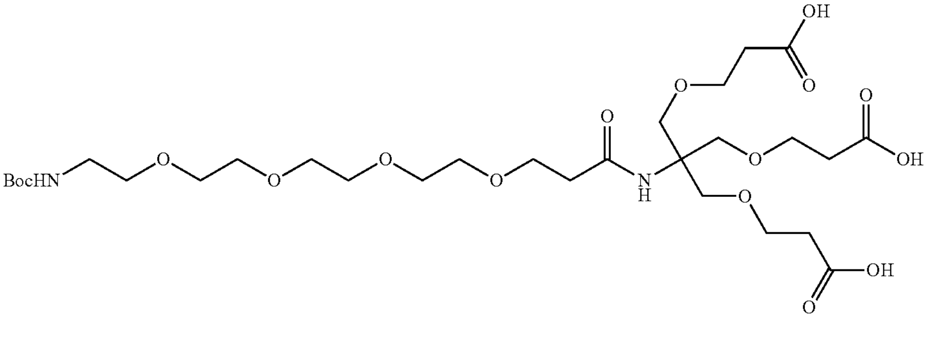

Following the similar procedure of BL4-3 except substituting BL6-1 (CAS: 174362-95-9) for BL4-1, compound BL6-3 (75 mg, 22% yield) was obtained as a white solid. ESI m/z: 685.3 $(M+H)^+$. $^1H$ NMR (400 MHz, $MeOD_{d4}$) δ 3.78-3.59 (m, 26H), 3.52 (t, J=5.6 Hz, 2H), 3.24 (t, J=5.6 Hz, 2H), 2.50 (t, J=6.3 Hz, 2H), 2.41 (t, J=6.7 Hz, 6H), 1.44 (s, 9H) ppm.

Example 17G: tert-Butyl N-(14-{[1,3-bis(2-{[2-(2-azidoethoxy)ethyl]carbamoyl}ethoxy)-2-[(2-{[2-(2-azidoethoxy)ethyl]carbamoyl}ethoxy)methyl]propan-2-yl]carbamoyl}-3,6,9,12-tetraoxatetradecan-1-yl) carbamate (BL6-5)

(BL6-5)

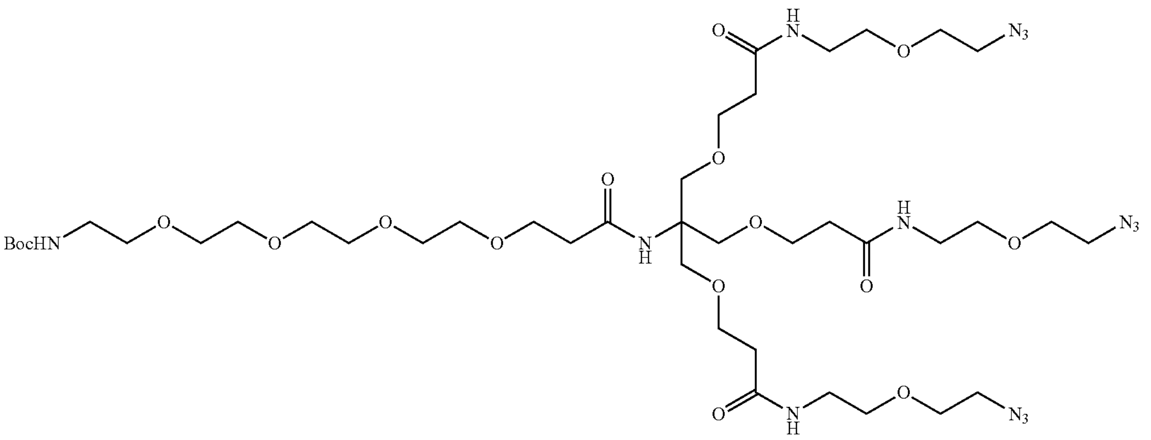

Following the similar procedure of BL4-5 except substituting BL5-4 for BL2-4 and substituting BL6-3 for BL4-3, compound BL6-5 (8 mg, 9% yield) was obtained as a yellow oil. ESI m/z: 1022.4 $(M+H)^+$. $^1H$ NMR (400 MHz, $MeOD_{d4}$) δ 3.72-3.49 (m, 40H), 3.43-3.35 (m, 12H), 3.26-3.18 (m, 2H), 2.50-2.41 (m, 8H), 1.44 (s, 9H) ppm.

Example 17H: 1-Amino-N-[1,3-bis(2-{[2-(2-azidoethoxy)ethyl]carbamoyl}ethoxy)-2-[(2-{[2-(2-azidoethoxy)ethyl]carbamoyl}ethoxy)methyl]propan-2-yl]-3,6,9,12-tetraoxapentadecan-15-amide (BL6)

(BL6)

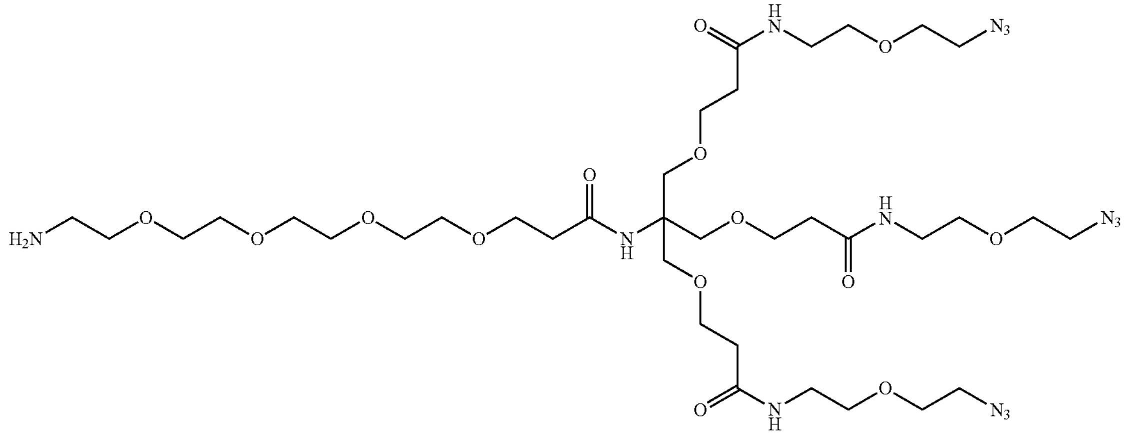

Following the similar procedure of BL5 except substituting BL6-5 for BL5-5, branched linker BL6 (4 mg, 55% yield) was obtained as a colorless oil. ESI m/z: 921.6 $(M+H)^+$. $^1H$ NMR (400 MHz, $MeCN_{d3}$) δ 6.90 (br s, 3H), 6.83 (br s, 1H), 3.67-3.55 (m, 30H), 3.52 (br t, J=5.6 Hz, 6H), 3.40-3.32 (m, 10H), 2.95 (br s, 2H), 2.47-2.40 (m, 4H), 2.39-2.32 (m, 12H) ppm.

Example 18: Synthesis of Cyclodextrin Linker BL10

Cyclodextrin linker BL10 synthesized as described in Scheme 22 and Examples 18A-18I, below.

Scheme 22: Synthesis of cyclodextrin linker BL10

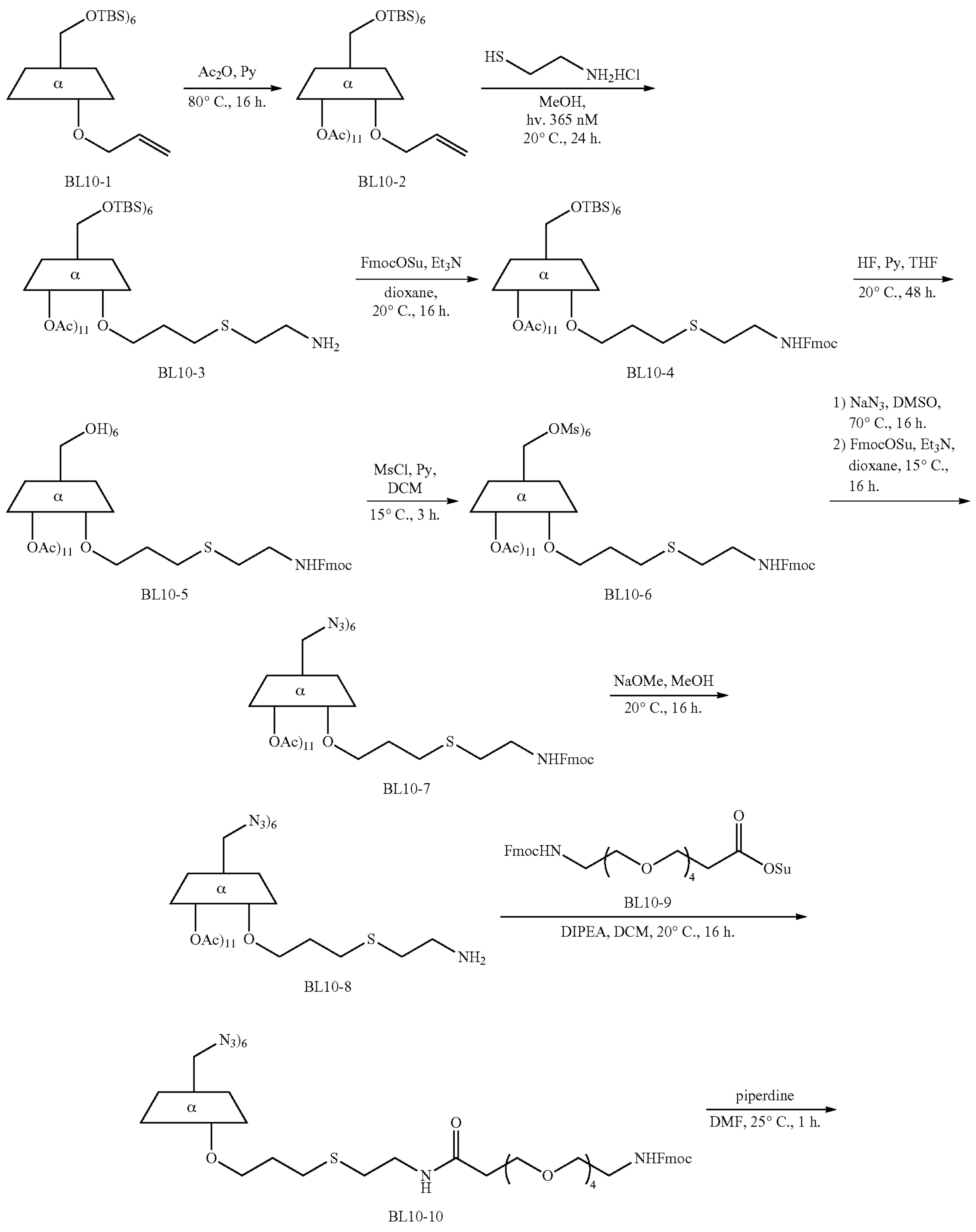

-continued
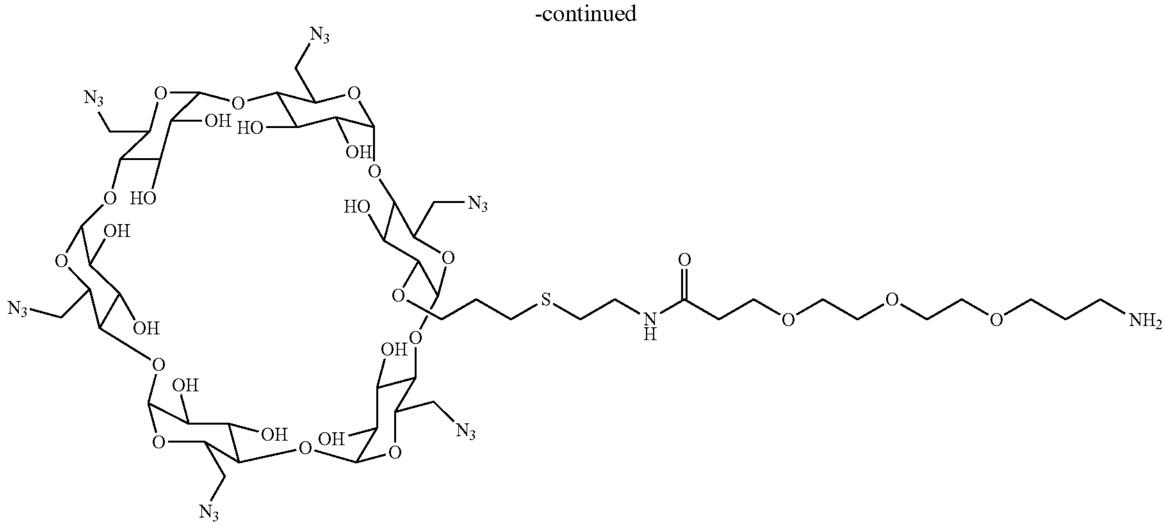
BL10
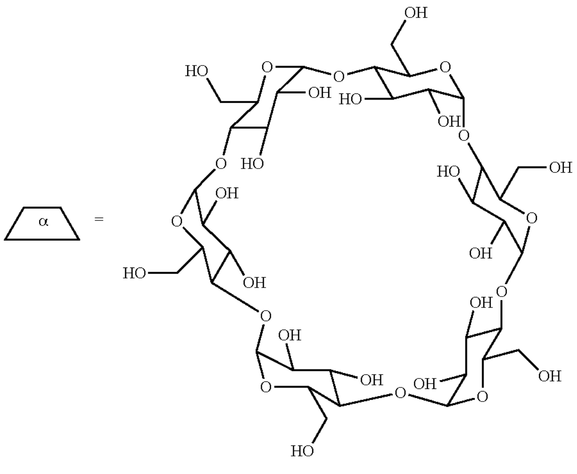
Compound BL10-1 was synthesized according to *J. Org. Chem.,* 1995, 60(15), 4786-97.

Example 18A: (1R,3R,5R,6R,8R,10R,11R,13R,15R,16R,18R,20R,21R,23R,25R,26R,28R,30R,31S,32R,33S,34R,35S,36R,37S,38R,39S,40R,41 S,42R)-33,34,35,36,37,38,39,40,41,42-Decakis(acetyloxy)-5,10,15,20,25,30-hexakis({[(tert-butyldimethylsilyl)oxy]methyl})-32-(prop-2-en-1-yloxy)-2,4,7,9,12,14,17,19,22,24,27,29-dodecaoxaheptacyclo[26.2.2.2$^{3}$, $^{6}$.2$^{8}$, $^{11}$.2$^{13}$, $^{16}$.2$^{18}$, $^{21}$.2$^{23}$, $^{26}$]dotetracontan-31-yl acetate (BL10-2)

(BL10-2)

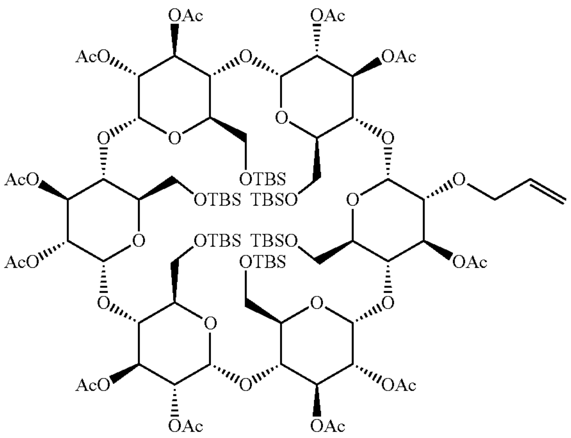

To a solution of compound BL10-1 (0.38 g, 0.22 mmol) in pyridine (3 mL) was added acetic anhydride (3 mL), and the reaction mixture was stirred at 80° C. for 16 hours. The reaction mixture was concentrated in vacuo and the brown residue was purified by silica gel flash chromatography (0-100% ethyl acetate in petroleum ether) to give compound BL10-2 (0.41 g, 85% yield) as a white solid. $^1$H NMR (400 MHz, $CDCl_3$) δ 5.77 (tdd, J=5.7, 10.9, 16.8 Hz, 1H), 5.57-5.34 (m, 5H), 5.24-4.92 (m, 8H), 4.78-4.60 (m, 5H), 4.30-3.53 (m, 26H), 3.16 (dd, J=2.9, 9.9 Hz, 1H), 2.15-1.91 (m, 33H), 0.93-0.79 (m, 54H), 0.10-0.03 (m, 36H) ppm.

Example 18B: (1R,3R,5R,6R,8R,10R,11R,13S,15S,16S,18S,20S,21 S,23S,25S,26S,28R,30R,31 S,32R,33R,34S,35R,36S,37R,38S,39S,40R,41S,42R)-33,34,35,36,37,38,39,40,41,42-Decakis(acetyloxy)-32-{3-[(2-aminoethyl)sulfanyl]propoxy}-5,10,15,20,25,30-hexakis ({[(tert-butyldimethylsilyl)oxy]methyl})-2,4,7,9,12,14,17,19,22,24,27,29-dodecaoxaheptacyclo[26.2.2.2$^{3}$, $^{6}$.2$^{8}$, $^{11}$.2$^{13}$, $^{16}$.2$^{18}$, $^{21}$.2$^{23}$, $^{26}$]dotetracontan-31-yl acetate (BL10-3)

(BL10-3)

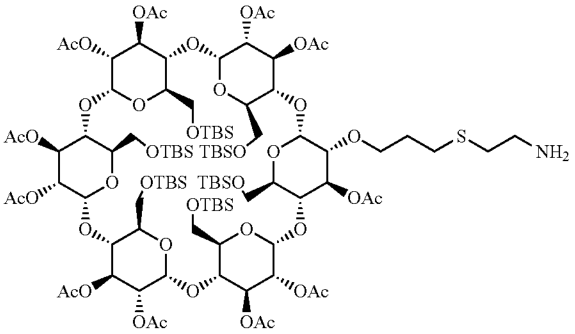

To a solution of compound BL10-2 (8.2 g, 3.8 mmol) in methanol (150 mL) was added cysteamine hydrochloride (4.3 g, 38 mmol), and the reaction mixture was degassed and purged with nitrogen for 3 times and was then stirred at 20° C. under UV light irradiation (λ=365 nm) under nitrogen protection for 24 hours. The reaction mixture was then concentrated in vacuo and the residue was dissolved in DCM (100 mL). The solution was washed successively with sat. aq. ammonium chloride (30 mL) and water (30 mL), dried over anhydrous sodium sulfate and concentrated in vacuo. The crude product was purified by silica gel flash chromatography (0-20% methanol in DCM) to give compound BL10-3 (1.5 g, 18% yield) as a white solid. $^1$H NMR (400 MHz, MeOD$_{d4}$) δ 5.55-5.28 (m, 6H), 5.20-5.00 (m, 6H), 4.63-4.43 (m, 5H), 4.28-4.15 (m, 4H), 4.14-4.05 (m, 2H), 4.02-3.59 (m, 20H), 3.52-3.41 (m, 1H), 3.32-3.09 (m, 2H), 2.93-2.81 (m, 1H), 2.79-2.68 (m, 1H), 2.54 (br t, J=6.7 Hz, 2H), 2.17-1.94 (m, 33H), 1.87-1.59 (m, 2H), 0.96-0.74 (m, 54H), 0.12-0.08 (m, 36H) ppm.

Example 18C: (1R,3R,5R,6R,8R,10R,11R,13S,15S,16S,18S,20S,21 S,23S,25S,26S,28R,30R,31 S,32R,33R,34S,35R,36S,37R,38S,39S,40R,41S,42R)-32,33,34,35,36,37,38,39,40,41-Decakis(acetyloxy)-5,10,15,20,25,30-hexakis({[(tert-butyldimethylsilyl)oxy]methyl})-42-{3-[(2-{[(9H-fluoren-9-ylmethoxy)carbonyl]amino}ethyl)sulfanyl]propoxy}-2,4,7,9,12,14,17,19,22,24,27,29-dodecaoxaheptacyclo[26.2.2.2$^{3, 6}$.2$^{8, 11}$.2$^{13, 16}$.2$^{18, 21}$.2$^{23, 26}$]dotetracontan-31-yl acetate (BL10-4)

(BL10-4)

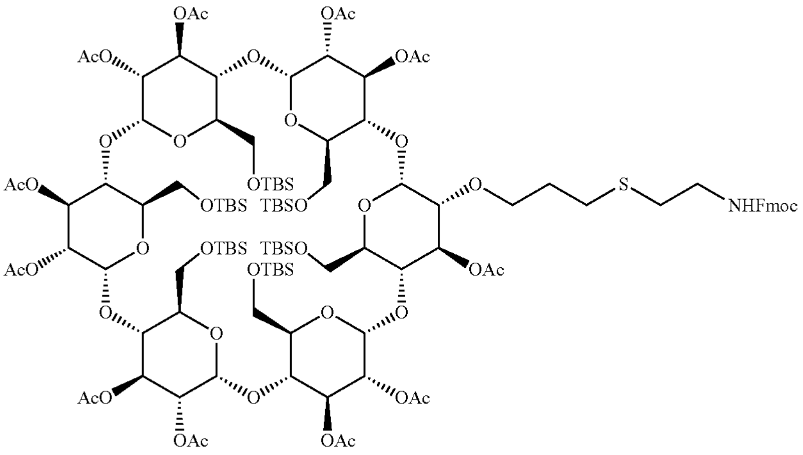

To a solution of compound BL10-3 (1.2 g, 0.54 mmol) in dioxane (20 mL) were added FmocOSu (CAS: 82911-69-1) (0.20 g, 0.59 mmol) and triethylamine (0.16 g, 1.6 mmol), and the reaction mixture was degassed and purged with nitrogen for 3 times before stirred at 20° C. for 16 hours under nitrogen protection. The resulting mixture was diluted with DCM (100 mL) and washed successively with sat. aq. ammonium chloride (20 mL) and water (20 mL). The organic solution was dried over anhydrous sodium sulfate and concentrated in vacuo. The residue was purified by silica gel flash chromatography (0-10% methanol in DCM) to give compound BL10-4 (1.3 g, 99% yield) as a white solid. $^1$H NMR (400 MHz, $CDCl_3$) δ 7.72 (d, J=7.6 Hz, 2H), 7.55 (d, J=7.6 Hz, 2H), 7.38-7.31 (m, 2H), 7.30-7.23 (m, 2H), 5.52-5.29 (m, 6H), 5.21 (br d, J=8.8 Hz, 1H), 5.14-4.92 (m, 6H), 4.80-4.55 (m, 5H), 4.34 (br d, J=7.1 Hz, 2H), 4.25-3.76 (m, 19H), 3.72-3.53 (m, 7H), 3.45-3.25 (m, 3H), 3.08 (dd, J=2.8, 9.9 Hz, 1H), 2.66-2.43 (m, 4H), 2.11-1.88 (m, 33H), 1.72 (br d, J=4.9 Hz, 2H), 0.94-0.72 (m, 54H), 0.07-0.06 (m, 36H) ppm.

Example 18D: (1R,3R,5R,6R,8R,10R,11R,13S,15S,16S,18S,20S,21 S,23S,25S,26S,28R,30R,31 S,32R,33R,34S,35R,36S,37R,38S,39S,40R,41S,42R)-32,33,34,35,36,37,38,39,40,41-decakis(acetyloxy)-42-{3-[(2-{[(9H-fluoren-9-ylmethoxy)carbonyl]amino}ethyl) sulfanyl]propoxy}-5,10,15,20,25,30-hexakis(hydroxymethyl)-2,4,7,9,12,14,17,19,22,24,27,29-dodecaoxaheptacyclo[26.2.2.2$^{3}$, $^{6}$.2$^{8}$, $^{11}$.2$^{13}$, $^{16}$.2$^{18}$, $^{21}$.2$^{23}$, $^{26}$]dotetracontan-31-yl acetate (BL10-5)

(BL10-5)

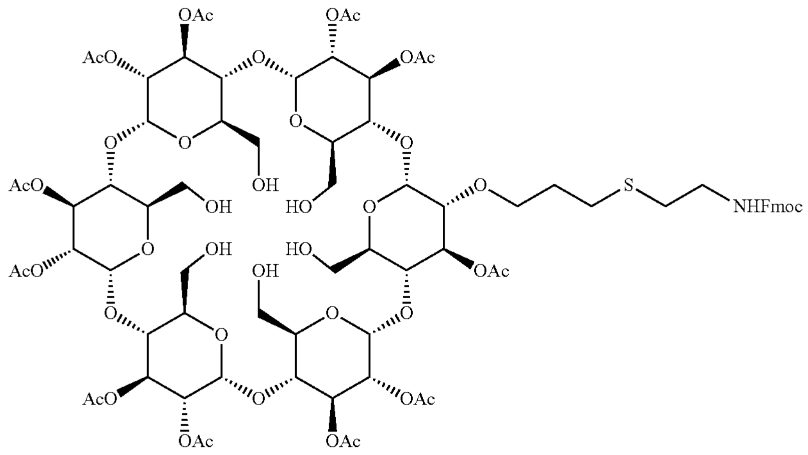

To a solution of compound BL10-4 (1.3 g, 0.53 mmol) in THF (15 mL) and pyridine (15 mL) was added pyridine hydrofluoride (70%, 3.7 g, 26 mmol), and the reaction mixture was stirred at 20° C. for 48 hours. The resulting mixture was poured into sat. aq. sodium bicarbonate (100 mL), and was then extracted with DCM (100 mL×2). The combined organic solution was dried over anhydrous sodium sulfate and concentrated in vacuo. The crude product was purified by silica gel flash chromatography (0-15% methanol in DCM) to give compound BL10-5 (0.74 g, 75% yield) as a white solid. $^{1}$H NMR (400 MHz, $CDCl_3$+$D_2O$) δ 7.74 (d, J=7.6 Hz, 2H), 7.58 (d, J=7.6 Hz, 2H), 7.41-7.34 (m, 2H), 7.32-7.25 (m, 2H), 5.53-5.35 (m, 6H), 5.25 (br s, 1H), 5.13-4.93 (m, 6H), 4.86-4.68 (m, 5H), 4.47-4.30 (m, 2H), 4.25-4.15 (m, 1H), 4.11-3.91 (m, 12H), 3.89-3.57 (m, 13H), 3.51 (br s, 1H), 3.36 (br d, J=5.9 Hz, 2H), 3.28 (br d, J=12.0 Hz, 1H), 2.69-2.43 (m, 4H), 2.14-1.90 (m, 33H), 1.81-1.64 (m, 2H) ppm.

Example 18E: (1R,3R,5R,6R,8R,10R,11R,13S,15S,16S,18S,20S,21 S,23S,25S,26S,28R,30R,31 S,32R,33R,34S,35R,36S,37R,38S,39S,40R,41S,42R)-32,33,34,35,36,37,38,39,40,41-Decakis(acetyloxy)-42-{3-[(2-{[(9H-fluoren-9-ylmethoxy)carbonyl]amino}ethyl)sulfanyl]propoxy}-5,10,15,20,25,30-hexakis[(methanesulfonyloxy)methyl]-2,4,7,9,12,14,17,19,22,24,27,29-dodecaoxaheptacyclo[26.2.2.2$^{3}$, $^{6}$.2$^{8}$, $^{11}$.2$^{13}$, $^{16}$.2$^{18}$, $^{21}$.2$^{23}$, $^{26}$]dotetracontan-31-yl acetate (BL10-6)

(BL10-6)

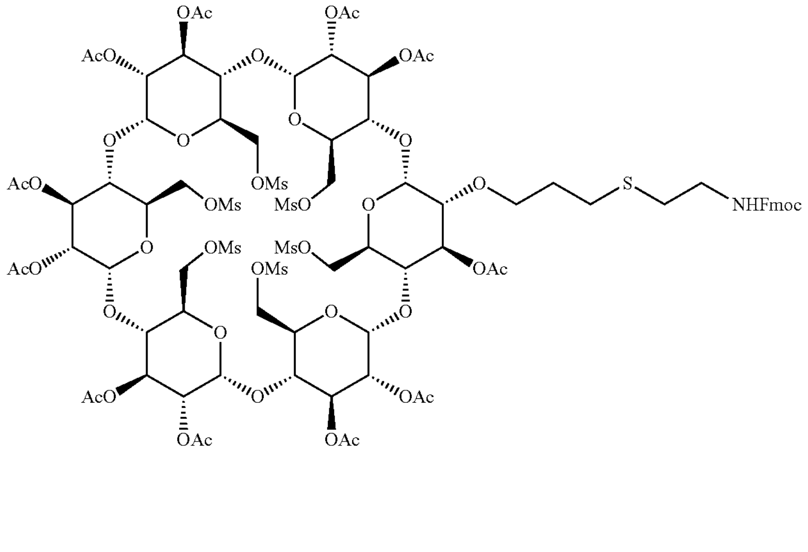

To a solution of compound BL10-5 (0.10 g, 56 μmol) in DCM (2 mL) were added methane sulfonyl chloride (0.15 g, 1.4 mmol) and pyridine (0.16 g, 2.0 mmol), and the reaction mixture was stirred at 15° C. for 3 hours. The resulting mixture was poured into sat. aq. sodium bicarbonate (10 mL) and extracted with DCM (10 mL×2). The combined organic solution was washed with aq. hydrochloride (1.0 N, 10 mL) and water (10 mL), dried over anhydrous sodium sulfate and concentrated in vacuo. The residue was purified by silica gel flash chromatography (0-70% ethyl acetate in DCM) to give compound BL10-6 (98 mg, 78% yield) as a white solid. $^1$H NMR (400 MHz, $CDCl_3$) δ 7.74 (d, J=7.6 Hz, 2H), 7.57 (br d, J=7.3 Hz, 2H), 7.42-7.33 (m, 2H), 7.32-7.25 (m, 2H), 5.56-5.36 (m, 5H), 5.33-5.22 (m, 2H), 5.11-4.95 (m, 6H), 4.91-4.75 (m, 5H), 4.70-4.31 (m, 14H), 4.28-4.13 (m, 6H), 3.93-3.79 (m, 5H), 3.73 (br t, J=9.0 Hz, 1H), 3.63 (br s, 1H), 3.48 (br d, J=9.8 Hz, 1H), 3.36 (br d, J=6.4 Hz, 2H), 3.29-3.17 (m, 2H), 3.15-2.98 (m, 18H), 2.70-2.42 (m, 4H), 2.11-1.90 (m, 33H), 1.81-1.64 (br s, 2H) ppm.

Example 18F: (1R,3R,5R,6R,8R,10R,11R,13S,15S,16S,18S,20S,21S,23S,25S,26S,28R,30R,31 S,32R,33R,34S,35R,36S,37R,38S,39S,40R,41S,42R)-32,33,34,35,36,37,38,39,40,41-Decakis(acetyloxy)-5,10,15,20,25,30-hexakis(azidomethyl)-42-{3-[(2-{[(9H-fluoren-9-ylmethoxy)carbonyl]amino}ethyl)sulfanyl]propoxy}-2,4,7,9,12,14,17,19,22,24,27,29-dodecaoxaheptacyclo[26.2.2.2$^{3,6}$.2$^{8,11}$.2$^{13,16}$.2$^{18,21}$.2$^{23,26}$]dotetracontan-31-yl acetate (BL10-7)

(BL10-7)

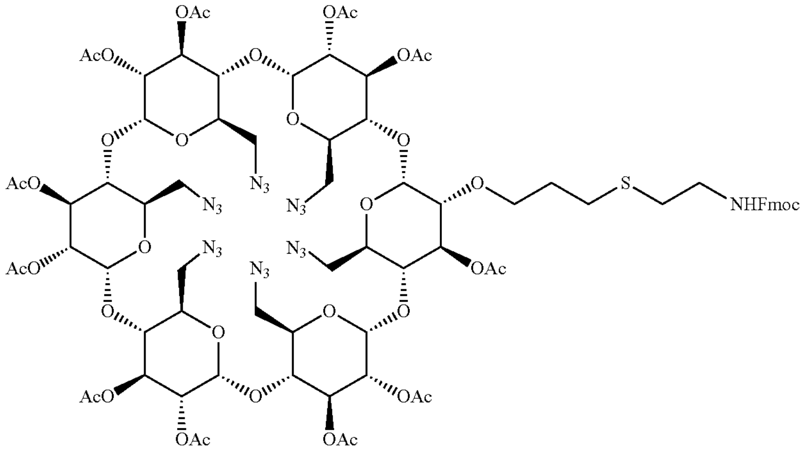

To a solution of compound BL10-6 (0.33 g, 0.15 mmol) in dry DMSO (5 mL) was added sodium azide (0.29 g, 4.4 mmol), and the reaction mixture was stirred at 70° C. for 16 hours. The resulting mixture was poured into water (20 mL) and extracted with DCM (20 mL×2). The combined organic solution was dried over anhydrous sodium sulfate and concentrated in vacuo to give a yellow gum (0.31 g), which was dissolved in dioxane (3 mL). To the solution were added FmocOSu (73 mg, 0.22 mmol) and triethylamine (55 mg, 0.55 mmol), and the mixture was degassed and purged with nitrogen for 3 times before stirred under nitrogen protection at 15° C. for 16 hours. The resulting mixture was quenched with sat. aq. ammonium chloride (20 mL) and extracted with DCM (10 mL×2). The combined organic solution was dried over anhydrous sodium sulfate and concentrated in vacuo. The residue was purified by silica gel flash chromatography (0-3% methanol in DCM) to give crude product (0.17 g) as a white solid, which was further purified by prep-TLC ($SiO_2$, eluted with 6.25% ethanol in DCM) to give compound BL10-7 (0.13 g, 41% yield) as a white solid. HRMS ESI m/z: 1924.6212 $(M+H)^+$ (calcd. 1924.6086), 1946.6057 $(M+Na)^+$. $^1$H NMR (400 MHz, $CDCl_3$) δ 7.78 (d, J=7.6 Hz, 2H), 7.60 (br d, J=7.3 Hz, 2H), 7.45-7.36 (m, 2H), 7.36-7.29 (m, 2H), 5.53-5.35 (m, 5H), 5.28 (br s, 1H), 5.12-4.97 (m, 5H), 4.96-4.74 (m, 6H), 4.40 (br d, J=7.1 Hz, 2H), 4.24 (br d, J=6.6 Hz, 1H), 4.12-3.91 (m, 6H), 3.88-3.48 (m, 21H), 3.40 (br d, J=5.9 Hz, 2H), 3.27 (br dd, J=2.9, 10.0 Hz, 1H), 2.71-2.47 (m, 4H), 2.11-1.95 (m, 33H), 1.78 (br s, 2H) ppm.

Example 18G: (1S,3R,5R,6S,8R,10R,11S,13R,15R,16S,18R,20R,21S,23R,25R,26S,28R,30R,31R,32R,33R,34R,35R,36R,37R,38R,39R,40R,41 S,42R)-42-{3-[(2-Aminoethyl) sulfanyl]propoxy}-5,10,15,20,25,30-hexakis(azidomethyl)-2,4,7,9,12,14,17,19,22,24,27,29-dodecaoxaheptacyclo[26.2.2.2$^{3}$, $^{6}$.2$^{8}$, $^{11}$.2$^{13}$, $^{16}$.2$^{18}$, $^{21}$.2$^{23}$, $^{26}$]dotetracontan-31,32,33,34,35,36,37,38,39,40,41-undecol (BL10-8)

(BL10-8)

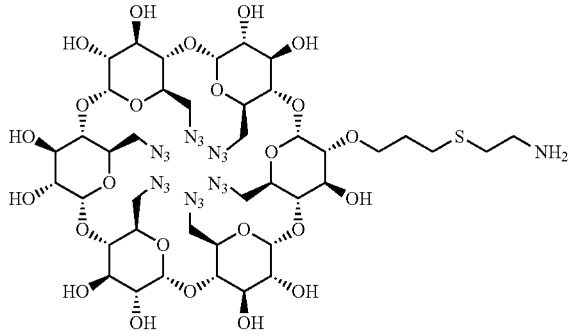

To a solution of compound BL10-7 (0.11 g, 57 μmol) in methanol (5 mL) was added sodium methylate (0.12 g, 2.3 mmol), and the reaction mixture was stirred at 20° C. for 16 hours. The resulting mixture was neutralized by addition of ion-exchange resin Amberlyst (R) 15 (hydrogen form) to pH 6.0. The mixture was filtered to remove resin and the filtrate was concentrated in vacuo. The residue was treated with distilled water (40 mL) and washed with MTBE (20 mL×3). The aqueous phase was lyophilized to give a white residue (52 mg), which was suspended into acetonitrile (AR grade, 4 mL). The white suspension was triturated in supersonic wave for 10 minutes, centrifuged at 5000 rpm for 15 minutes and decanted to collect the white solid. The process was repeated 3 times. The resulting white solid was dissolved into distilled water (20 mL) and then lyophilized to give compound BL10-8 (34 mg, 47% yield) as a white solid. ESI m/z: 1240.5 $(M+H)^+$. $^1$H NMR (400 MHz, $DMSO_{d6}+D_2O$) δ4.99 (br s, 1H), 4.83 (br s, 5H), 3.76 (br d, J=10.5 Hz, 7H), 3.70-3.58 (m, 13H), 3.53-3.42 (m, 6H), 3.39-3.24 (m, 12H), 2.91 (br t, J=6.5 Hz, 2H), 2.66-2.59 (m, 2H), 2.55-2.51 (m, 2H), 1.75-1.60 (m, 2H) ppm.

Example 18H: 9H-Fluoren-9-ylmethyl N-[14-({2-[(3-{[(1S,3R,5R,6S,8R,10R,11 S,13R,15R,16S,18R,20R,21S,23R,25R,26S,28R,30R,31S,32R,33R,34R,35R,36R,37R,38R,39R,40R,41R,42R)-5,10,15,20,25,30-hexakis(azidomethyl)-31,33,34,35,36,37,38,39,40,41,42-undecahydroxy-2,4,7,9,12,14,17,19,22,24,27,29-dodecaoxaheptacyclo[26.2.2.2$^{3}$, $^{6}$.2$^{8}$, $^{11}$.2$^{13}$, $^{16}$.2$^{18}$, $^{21}$.2$^{23}$, $^{26}$]dotetracontan-32-yl]oxy}propyl)sulfanyl]ethyl}carbamoyl)-3,6,9,12-tetraoxatetradecan-1-yl]carbamate (BL10-10)

(BL10-10)

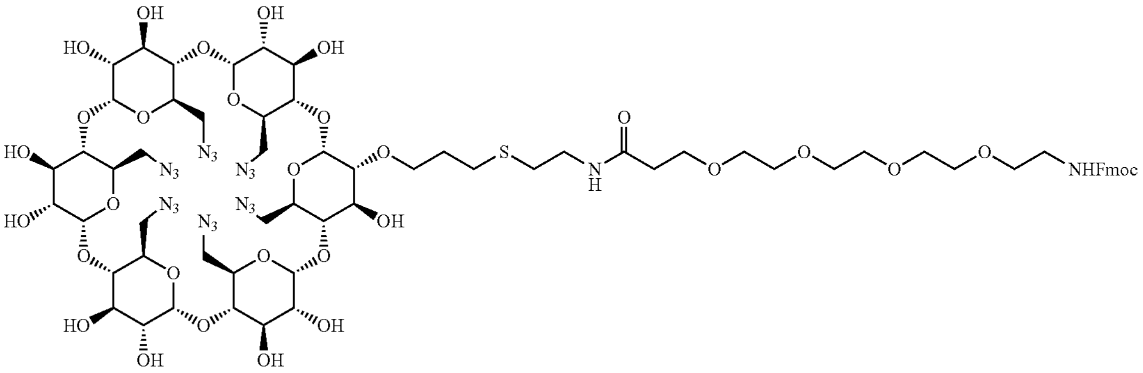

To a solution of active ester BL10-9 (9.0 mg, 15 μmol) and compound BL10-8 (19 mg, 15 μmol) in DMF (0.3 mL) was added DIPEA (6.0 mg, 46 μmol), and the reaction mixture was stirred at 25° C. for an hour. The resulting mixture was directly purified by reversed phase flash chromatography (0-70% acetonitrile in aq. acetic Acid (0.5%)) twice to give compound BL10-10 (6.7 mg, 24% yield) as a white solid. $^1$H NMR (400 MHz, $DMSO_{d6}+D_2O$) δ 7.89-7.83 (m, 2H), 7.69-7.60 (m, 2H), 7.44-7.37 (m, 2H), 7.35-7.27 (m, 2H), 5.04 (br s, 1H), 4.86 (br s, 5H), 4.30-4.18 (m, 3H), 3.77-3.76 (m, 20H), 3.61-3.51 (m, 10H), 3.50-3.42 (m, 12H), 3.36 (br d, J=5.8 Hz, 14H), 3.28-3.08 (m, 6H), 2.29 (br t, J=6.4 Hz, 2H), 1.77-1.63 (m, 2H) ppm.

Example 181: 1-Amino-N-{2-[(3-{[(1S,3R,5R,6S,8R,10R,11S,13R,15R,16S,18R,20R,21 S,23R,25R,26S,28R,30R,31S,32R,33R,34R,35R,36R,37R,38R,39R,40R,41R,42R)-5,10,15,20,25,30-hexakis(azidomethyl)-31,33,34,35,36,37,38,39,40,41,42-undecahydroxy-2,4,7,9,12,14,17,19,22,24,27,29-dodecaoxaheptacyclo[26.2.2.2$^{3}$, $^{6}$.2$^{8}$, $^{11}$.2$^{13}$, $^{16}$.2$^{18}$, $^{21}$.2$^{23}$, $^{26}$]dotetracontan-32-yl]oxy}propyl)sulfanyl]ethyl}-3,6,9,12-tetraoxapentadecan-15-amide (BL10)

(BL10)

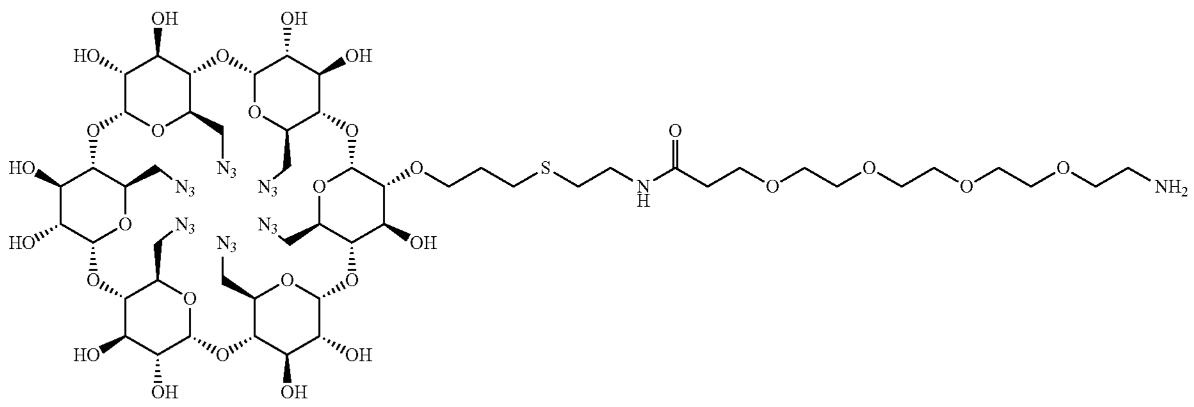

To a solution compound BL10-10 (6.7 mg, 3.9 μmol) in DMF (0.2 mL) was added piperidine (3.3 mg, 39 μmol), and the reaction mixture was stirred at 25° C. for an hour until Fmoc was totally removed, which was monitored by LCMS. The resulting mixture was diluted with distilled water (10 mL) and lyophilized. The residual off-white solid was purified by reversed phase flash chromatography (0-70% acetonitrile in aq. acetic acid (0.5%)) to give cyclodextrin-linker BL10 (2.1 mg, 36% yield) as a white solid. ESI m/z: 1488.2 $(M+H)^+$. $^1$H NMR (400 MHz, MeOD$_{d4}$) δ 5.06 (d, J=3.2 Hz, 1H), 4.94 (br d, J=2.4 Hz, 5H), 4.02-3.84 (m, 1H), 4.03-3.72 (m, 21H), 3.71-3.49 (m, 24H), 3.47-3.34 (m, 9H), 3.48 (br s, 1H), 2.99 (t, J=5.1 Hz, 2H), 2.69-2.61 (m, 4H), 2.47 (t, J=6.0 Hz, 2H), 1.91-1.84 (m, 2H) ppm.

Example 19: Synthesis of Glucose Linker BL11

Glucose linker BL111 was synthesized as described in Scheme 23 and Examples 19A-19F, below.

Scheme 23: Synthesis of glucose linker BL11

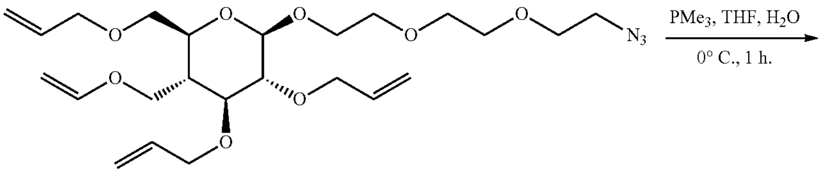

BL11-1

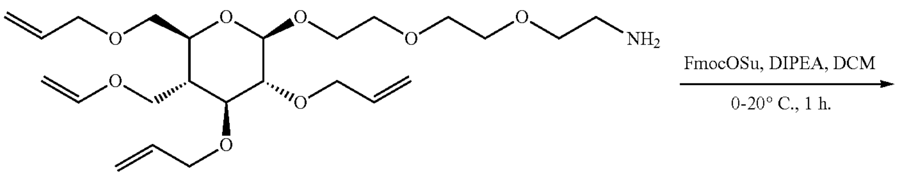

BL11-2

-continued

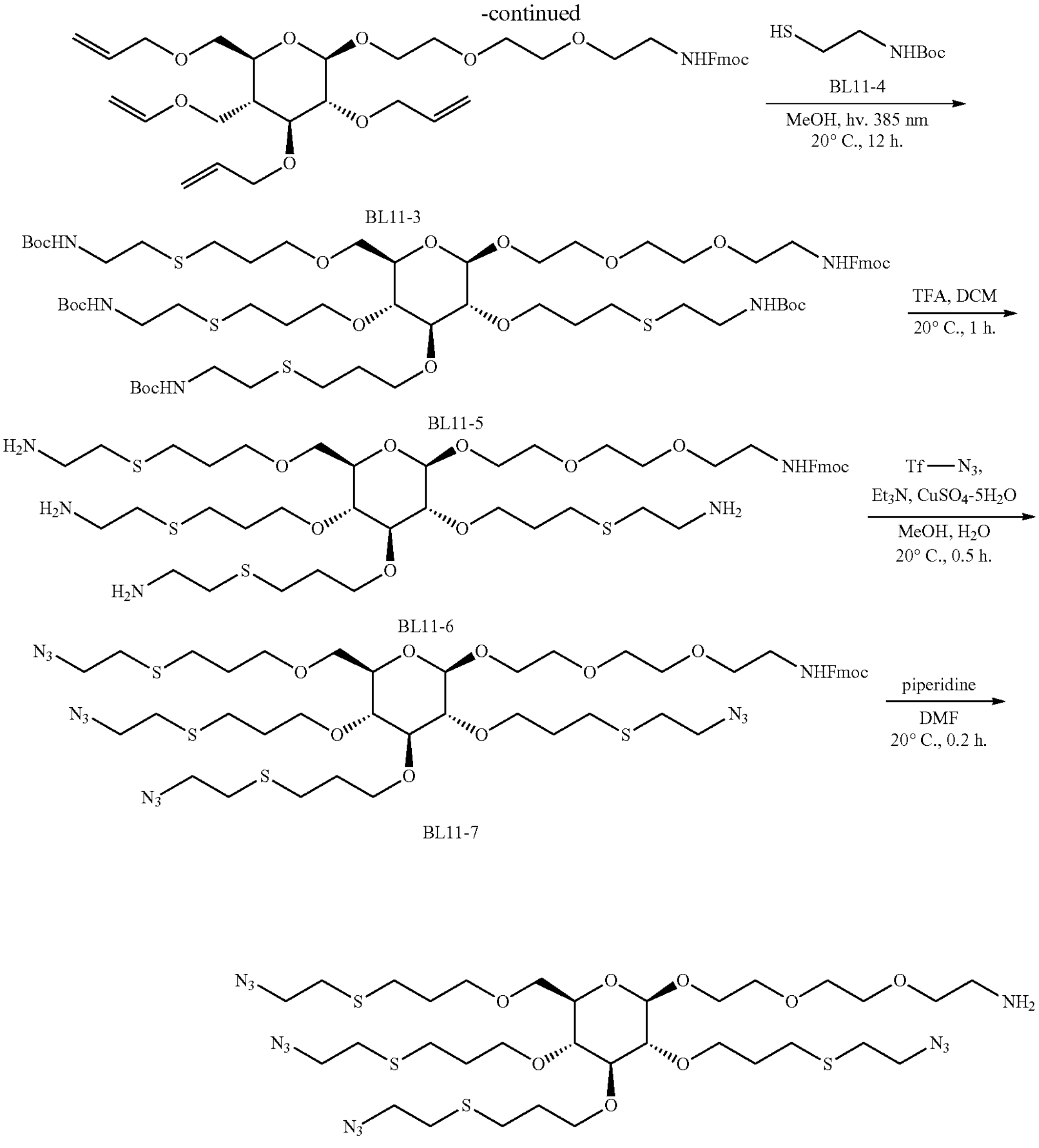

BL11-3

BL11-5

BL11-6

BL11-7

BL11

Compound BL11-1 was synthesized according to Org. Biomol. Chem., 2007, 5(21), 3477-3485.

Example 19A: 2-[2-(2-{[(2R,3R,4S,5R,6R)-3,4,5-Tris(prop-2-en-1-yloxy)-6-[(prop-2-en-1-yloxy)methyl]oxan-2-yl]oxy}ethoxy)ethoxy]ethan-1-amine (BL11-2)

(BL11-2)

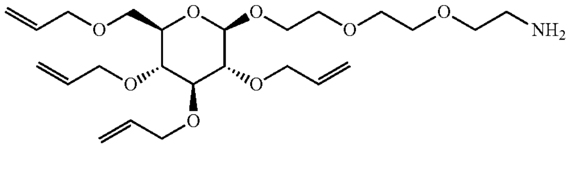

To a solution of compound BL11-1 (0.60 g, 1.2 mmol) in THF (10 mL) and water (1.5 mL) was added trimethylphosphine (1 M in THF, 1.8 mL, 1.8 mmol) at 0° C., and the reaction mixture was stirred at 0° C. for an hour, which was monitored by TLC (eluted with 25% ethyl acetate in petroleum ether). The resulting mixture was then poured into ice-water (20 mL) and was stirred for 2 minutes. The aqueous mixture was extracted with ethyl acetate (30 mL×3). The combined organic solution was washed with brine (20 mL×3), dried over anhydrous sodium sulfate and concentrated in vacuo to give crude product BL11-2 (0.55 g, 87% yield) as a yellow oil, which was used for the next step without further purification. ESI m/z: 472.3 $(M+H)^+$. $^1H$ NMR (400 MHz, $CDCl_3$) δ 6.11-5.82 (m, 4H), 5.34-5.22 (m, 4H), 5.22-5.06 (m, 4H), 4.42-3.96 (m, 10H), 3.76-3.58 (m, 9H), 3.55-3.47 (m, 2H), 3.44-3.29 (m, 3H), 3.27-3.16 (m, 1H), 2.96-2.76 (m, 2H) ppm.

Example 19B: 9H-Fluoren-9-ylmethyl N-{2-[2-(2-{[(2R,3R,4S,5R,6R)-3,4,5-tris(prop-2-en-1-yloxy)-6-[(prop-2-en-1-yloxy)methyl]oxan-2-yl]oxy}ethoxy)ethoxy]ethyl}carbamate (BL11-3)

(BL11-3)

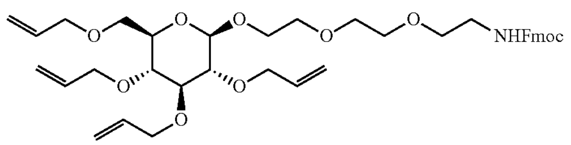

To a solution of compound BL11-2 (0.50 g, 1.1 mmol) and DIPEA (0.41 g, 3.2 mmol) in DCM (5 mL) was added FmocOSu (0.43 g, 1.3 mmol) in portions under nitrogen over 15 minutes at 0° C. The mixture was stirred at 20° C. for an hour, which was monitored by LCMS. The resulting mixture was poured into water (20 mL) and stirred for 2 minutes. The aqueous mixture was extracted with ethyl acetate (30 mL×3). The combined organic solution was washed with brine (20 mL×3), dried over anhydrous sodium sulfate and concentrated in vacuo. The residue was purified by silica gel flash chromatography (0-50% ethyl acetate in petroleum ether) to give compound BL11-3 (0.55 g, 71% yield) as a light yellow oil. ESI m/z: 716.3 $(M+Na)^+$. $^1H$ NMR (400 MHz, $CDCl_3$) δ 7.77 (d, J=7.5 Hz, 2H), 7.61 (d, J=7.5 Hz, 2H), 7.44-7.37 (m, 2H), 7.35-7.28 (m, 2H), 6.02-5.83 (m, 4H), 5.42 (br s, 1H), 5.31-5.20 (m, 4H), 5.19-5.09 (m, 4H), 4.40-4.01 (m, 12H), 3.75-3.54 (m, 11H), 3.43-3.30 (m, 5H), 3.25-3.15 (m, 1H) ppm.

Example 19C: 9H-Fluoren-9-ylmethyl N-{2-[2-(2-{[(2R,3R,4S,5R,6R)-3,4,5-tris({3-[(2-{[(tert-butoxy)carbonyl]amino}ethyl)sulfanyl]propoxy})-6-({3-[(2-{[(tert-butoxy)carbonyl]amino}ethyl)sulfanyl]propoxy}methyl)oxan-2-yl]oxy}ethoxy)ethoxy]ethyl}carbamate (BL11-5)

(BL11-5)

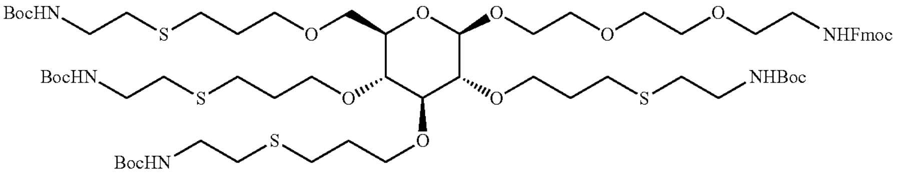

To a solution of compound BL11-3 (0.20 g, 0.29 mmol) in methanol (8 mL) charged in a quartz flask was added Boc-cysteamine BL11-4 (1.0 g, 5.8 mmol). The reaction mixture was degassed and purged with argon for 30 minutes and was then stirred at 20° C. under UV light irradiation (λ=254 nm) under nitrogen protection for 12 hours, which was monitored by LCMS. The resulting mixture was concentrated in vacuo, and the residue was purified by silica gel flash chromatography (0-80% ethyl acetate in petroleum ether) to give compound BL11-5 (0.30 g, 67% yield) as a yellow oil. ESI m/z: 1425.9 $(M+Na)^+$. $^1H$ NMR (400 MHz, $CDCl_3$) δ 7.77 (d, J=7.5 Hz, 2H), 7.62 (d, J=7.5 Hz, 2H), 7.44-7.38 (m, 2H), 7.35-7.29 (m, 2H), 5.04 (br s, 3H), 4.40 (br d, J=6.8 Hz, 2H), 4.28-4.20 (m, 2H), 4.02-3.47 (m, 20H), 3.41 (br d, J=4.8 Hz, 2H), 3.35-3.15 (m, 11H), 3.13-3.00 (m, 1H), 2.70-2.54 (m, 15H), 1.94-1.75 (m, 7H), 1.45 (s, 36H) ppm.

Example 19D: 9H-Fluoren-9-ylmethyl N-{2-[2-(2-{[(2R,3R,4S,5R,6R)-3,4,5-tris({3-[(2-aminoethyl)sulfanyl]propoxy})-6-({3-[(2-aminoethyl)sulfanyl]propoxy}methyl)oxan-2-yl]oxy}ethoxy)ethoxy]ethyl}carbamate (BL11-6)

(BL11-6)

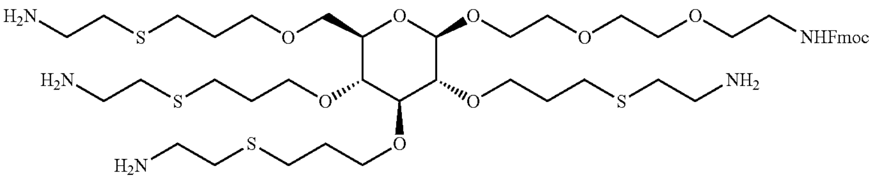

To a solution of compound BL11-5 (0.11 g, 78 μmol) in DCM (1.5 mL) was added TFA (1.7 g, 15 mmol), and the reaction mixture was stirred at 20° C. for an hour until Boc was totally removed, which was monitored by LCMS. The volatiles were removed in vacuo to give crude product BL11-6 (90 mg, 93% yield, TFA salt) as light yellow oil. ESI m/z: 1002.4 $(M+H)^+$.

Example 19E: 9H-Fluoren-9-ylmethyl N-{2-[2-(2-{[(2R,3R,4S,5R,6R)-3,4,5-tris({3-[(2-azidoethyl)sulfanyl]propoxy})-6-({3-[(2-azidoethyl)sulfanyl]propoxy}methyl)oxan-2-yl]oxy}ethoxy)ethoxy]ethyl}carbamate (BL11-7)

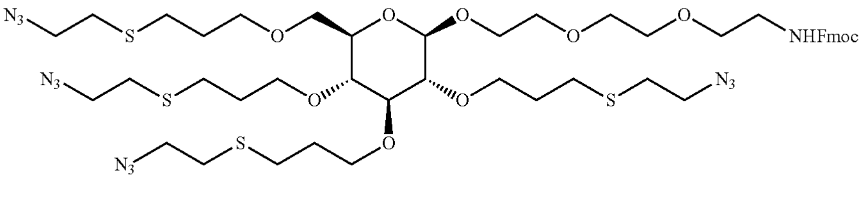
(BL11-7)

To a solution of compound BL11-6 (60 mg, 48 μmol, TFA salt) in methanol (1 mL) and water (0.5 mL) were added successively at 20° C. copper sulfate pentahydrate (0.48 g, 1.9 μmol), triethylamine (39 mg, 0.39 mmol) and a solution of trifluoromethanesulfonyl azide (42 mg, 0.24 mmol) in DCM (5 mL). The reaction mixture was stirred at 20° C. for half an hour. Reaction completion was monitored by LCMS. The resulting mixture was quenched with glycine (0.5 g) and stirred at 20° C. for half an hour. The mixture was filtered and the filtrate was partitioned between DCM (30 mL) and brine (15 mL). The organic solution was dried over anhydrous sodium sulfate and concentrated in vacuo to give compound BL11-7 (50 mg, 84% yield) as a yellow oil, which was used for the next step without further purification. ESI m/z: 1128.4 $(M+Na)^+$. $^1H$ NMR (400 MHz, $CDCl_3$) δ 7.78 (d, J=7.5 Hz, 2H), 7.62 (d, J=7.2 Hz, 2H), 7.44-7.38 (m, 2H), 7.36-7.30 (m, 2H), 5.46-5.40 (m, 1H), 5.38-5.32 (m, 1H), 4.40 (br d, J=6.8 Hz, 2H), 4.27-4.18 (m, 2H), 4.01-3.35 (m, 31H), 3.23-3.18 (m, 2H), 3.09 (q, J=7.3 Hz, 5H), 2.68-2.59 (m, 8H), 2.26-2.19 (m, 1H), 2.06-1.97 (m, 2H), 1.92-1.81 (m, 8H) ppm.

Example [19]F: 2-[2-(2-{[(2R,3R,4S,5R,6R)-3,4,5-Tris({3-[(2-azidoethyl)sulfanyl]propoxy})-6-({3-[(2-azidoethyl)sulfanyl]propoxy}methyl)oxan-2-yl]oxy}ethoxy)ethoxy]ethan-1-amine (BL11)

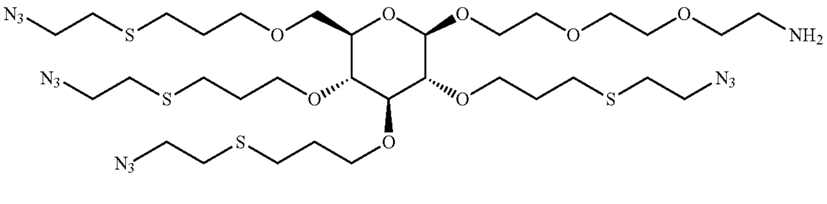
(BL11)

To a solution of compound BL11-7 (45 mg, 41 μmol) in DMF (0.2 mL) was added piperidine (35 mg, 0.41 mmol), and the reaction mixture was stirred at 20° C. for 0.2 hour, which was monitored by LCMS. The resulting mixture was concentrated in vacuo and the residue was purified by reversed phase flash chromatography (40-60% acetonitrile in aq. formic acid (0.225%)) to give glucose-linker BL11 (18 mg, 45% yield, formic acid salt) as a yellow oil. ESI m/z: 884.5 $(M+H)^+$. $^1H$ NMR (400 MHz, $CDCl_3$) δ 8.52 (s, 1H), 4.26 (d, J=7.8 Hz, 1H), 4.06-3.97 (m, 1H), 3.95-3.58 (m, 19H), 3.52-3.44 (m, 8H), 3.31-3.17 (m, 3H), 3.12-3.06 (m, 1H), 3.01 (t, J=4.9 Hz, 2H), 2.78-2.64 (m, 18H), 1.96-1.75 (m, 8H) ppm.

Example 20: ADC Conjugation

Figure 2A:
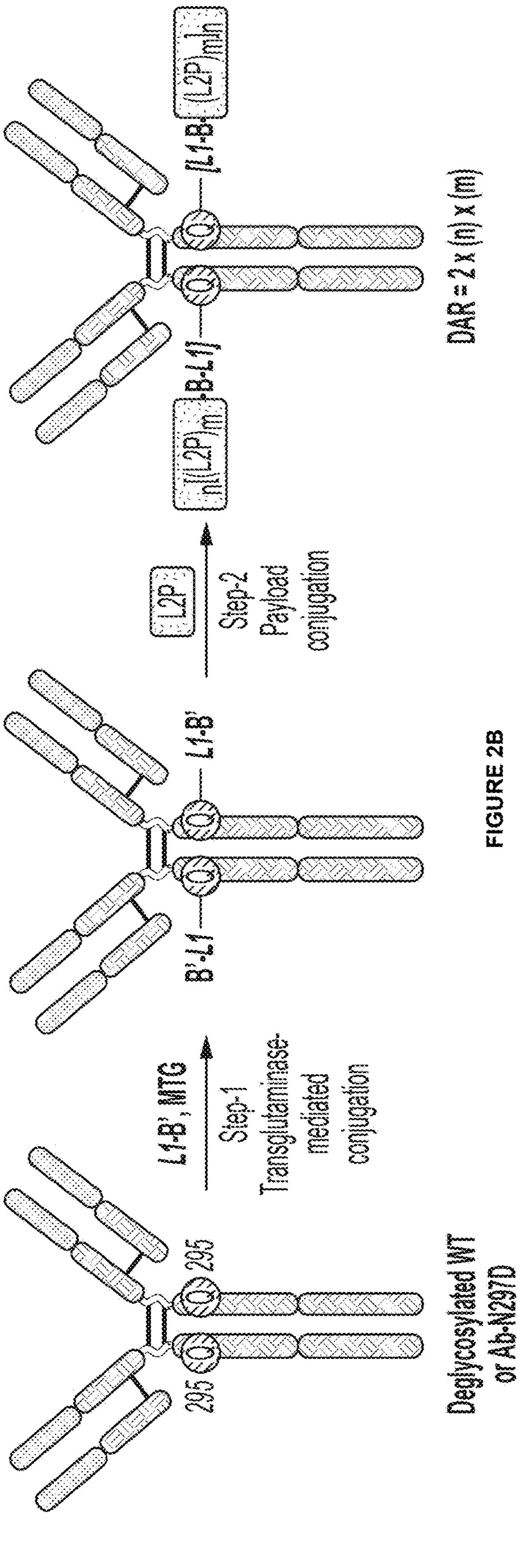
FIGS. 2A and 2B are schematics demonstrating specific non-limiting embodiments of the disclosure.
Figure 2B:
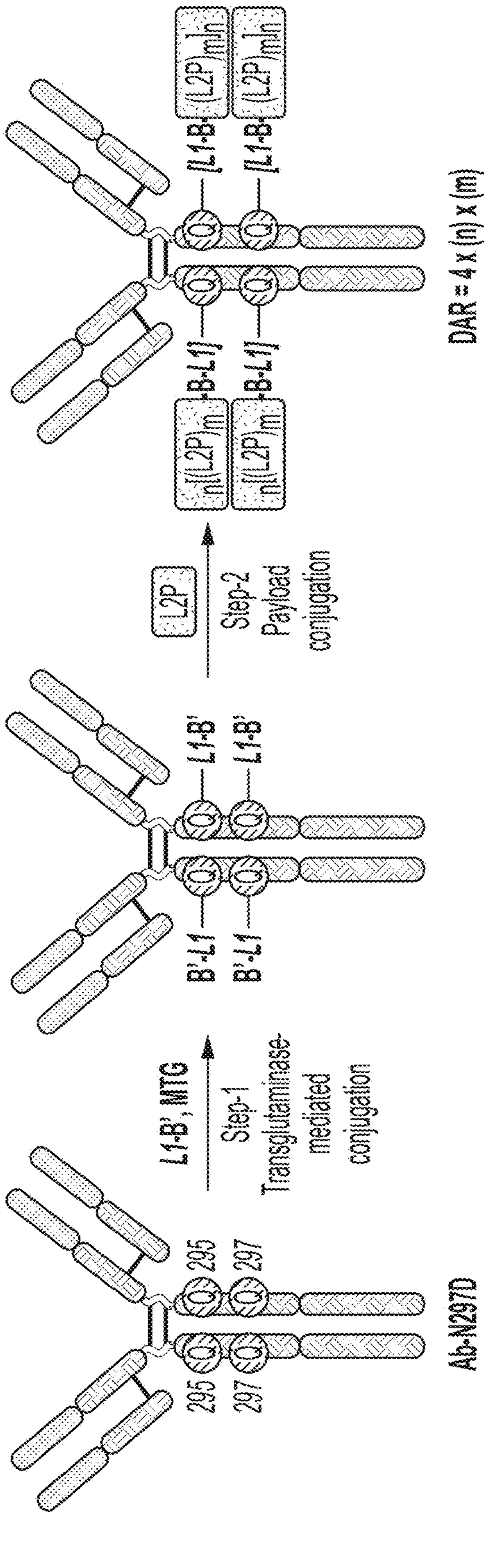

This example demonstrates a method for site-specific conjugation according to an embodiment of the disclosure, generally, of a payload to an antibody or an antigen-binding fragment thereof. This method includes a two-step process shown in FIGS. 2A and 2B. The first step is microbial transglutaminase (MTG) mediated attachment of Linker 1 (L1-B'), such as bis azido-alkyl substituted amine (BL7) or azide-$PEG_3$-amine (AL1), to the antibody, wherein an excess of the amine reagent was used to avoid potential cross-linking of antibody chains. The second step attached the alkyne-linked payload linker payload (L2P) to the $N_3$-tagged conjugate via a strain-promoted azide-alkyne cycloaddition (SPAAC). The number of L2P molecules added to the antibody is dependent on the number of conjugation sites and the number of azide functional groups (n) within $L_1$ (AL, n=1; BL, n≥2). For antibodies with a WT Fc domain that were enzymatically deglycosylated or have an N297D Fc mutation and then azido functionalized with AL or BL linkers, the expected DAR=2 times n times m, where n is the number of azide functional groups B' on each L1 linker, and m is the number of L2P payloads, respectively. For antibodies with an N297Q Fc mutation then azido functionalized with AL or BL linkers, the expected DAR=4×(n)×(m).

All parental antibody (Ab), azido-functionalized antibody containing 2, 4 or 8 azido groups $(Ab-(N_3)_n)$, final ADCs generated as specific examples and the corresponding linker-payload $(L_2P)$, as well as their ES-MS results and DAR values of the ADCs are summarized in Table 16.

TABLE 16

Antibodies, Antibody-linkers, and ADCs according to an embodiment of the disclosure

| Test Article | Antibody Description | Site of Conjugation | Modification AL, BL, LP # | Modification MW (g/mol) | DAR by ESI-MS | ESI-MS (m/z) |
|---|---|---|---|---|---|---|
| 1 | Anti-HER2 | | None | NA | NA | 145122 (degly) |
| 2 | Anti-HER2 | Q295 | $[AL1]_2$ | 218.3 | 2 | 145519 |
| 3 | Anti-HER2 | Q295 | $[AL1\text{-}LP1]_2$ | 1614.8 | 2 | 148330 |
| 4 | Isotype | | None | NA | NA | 145443 |
| 5 | Isotype | Q295 | $[AL1]_2$ | 218.3 | 2 | 145823 |
| 6 | Isotype | Q295 | $[AL1\text{-}LP1]_2$ | 1614.8 | 2 | 148619 |
| 7 | Anti-HER2 | | None | NA | NA | 145139 |
| 8 | Anti-HER2 | Q295, Q297 | $[AL1]_4$ | 218.3 | 4 | 145943 |
| 9 | Anti-HER2 | Q295, Q297 | $[BL7]_4$ | 325.4 | 4 | 146372 |
| 10 | Anti-HER2 | Q295, Q297 | $[AL1\text{-}LP1]_4$ | 1614.8 | 4 | 151544 |
| 11 | Anti-HER2 | Q295, Q297 | $[BL7\text{-}(LP1)_2]_4$ | 3118.4 | 8 | 157557 |
| 12 | Anti-STEAP2 | | None | NA | NA | 144006 |
| 13 | Anti-STEAP2 | Q295, Q297 | $[AL1]_4$ | 218.3 | 4 | 144787 |
| 14 | Anti-STEAP2 | Q295, Q297 | $[BL7]_4$ | 325.4 | 4 | 145208 |
| 15 | Anti-STEAP2 | Q295, Q297 | $[AL1\text{-}LP1]_4$ | 1614.8 | 4 | 150364 |
| 16 | Anti-STEAP2 | Q295, Q297 | $[BL7\text{-}(LP1)_2]_4$ | 3118.4 | 8 | 156381 |
| 17 | Isotype Control | | None | NA | NA | 145451 |
| 18 | Isotype Control | Q295, Q297 | $[AL1]_4$ | 218.3 | 4 | 146245 |
| 19 | Isotype Control | Q295, Q297 | $[BL7]_4$ | 325.4 | 4 | 146678 |
| 20 | Isotype Control | Q295, Q297 | $[AL1\text{-}LP1]_4$ | 1614.8 | 4 | 151849 |
| 21 | Isotype Control | Q295, Q297 | $[BL7\text{-}(LP1)_2]_4$ | 3118.4 | 8 | 157863 |

ESI-MS should approximate according to the following:
For Azido Functionalized Antibodies (i.e. no LP1); MW = $MW_{Ab}$ + (#Conjugation Sites) ($MW_{L1}$ − 18)
For ADC; MW = $MW_{Ab}$ + (#Conjugation Sites)($MW_{L1}$ − 18) + (DAR)($MW_{LP1}$)
$MW_{AL1}$ = 218.3 g/mol, $MW_{BL7}$ = 325.4 g/mol, $MW_{LP1}$ = 1396.5 g/mol Table 17, below, provides the structures of ADCs generated using the two-step methods according to the present disclosure.

TABLE 17
structures of ADCs according to the present disclosure
| Test Article | Ab | Site of Conj. | Mod./ Des. | Structure of Modification | DAR |
|---|---|---|---|---|---|
| 3 | Anti-HER2 | Q295 | [AL1-LP1]$_2$ (Azido) | 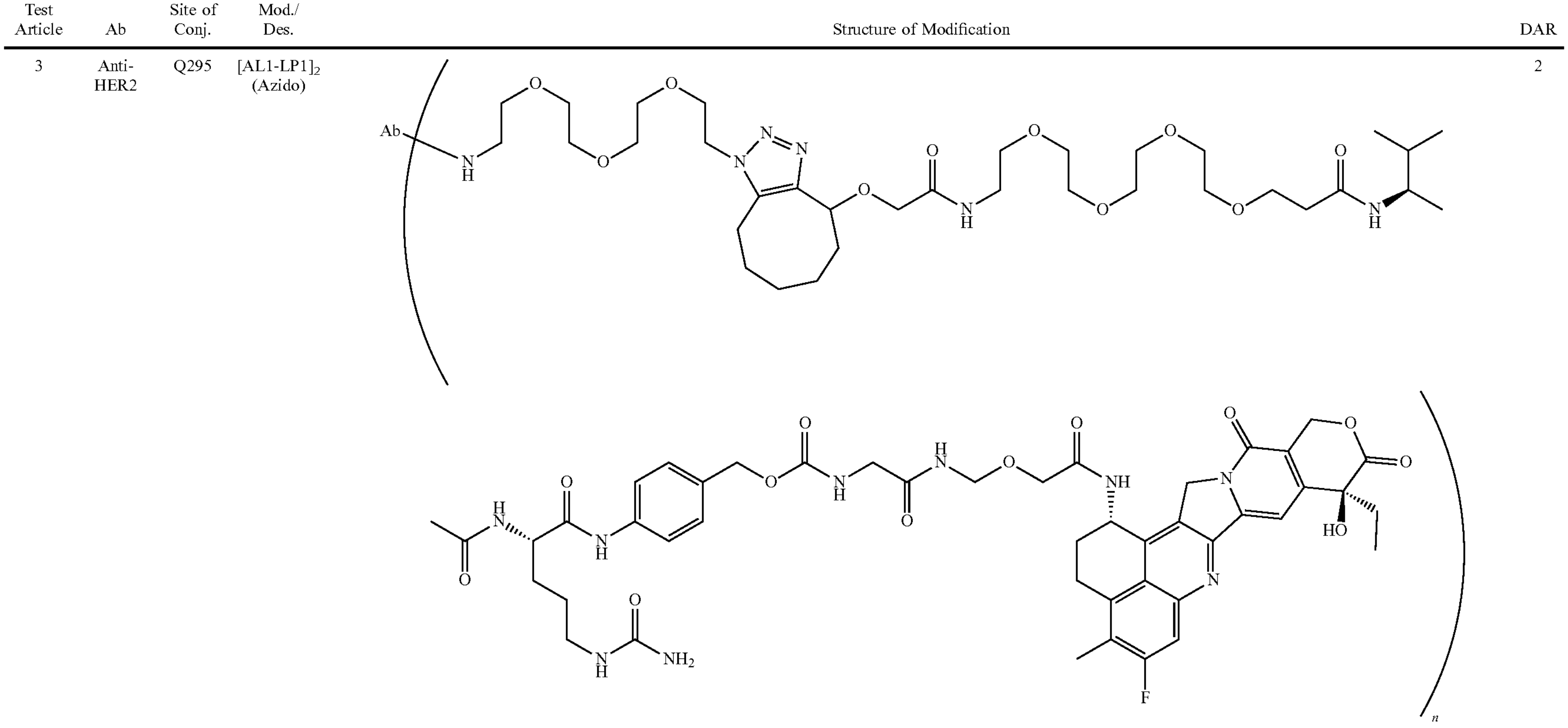 | 2 |

TABLE 17-continued
| structures of ADCs according to the present disclosure | | | | | |
|---|---|---|---|---|---|
| Test Article | Ab | Site of Conj. | Mod./ Des. | Structure of Modification | DAR |
| 6 | Isotype | Q295 | $[AL1-LP1]_2$ (Azido) | 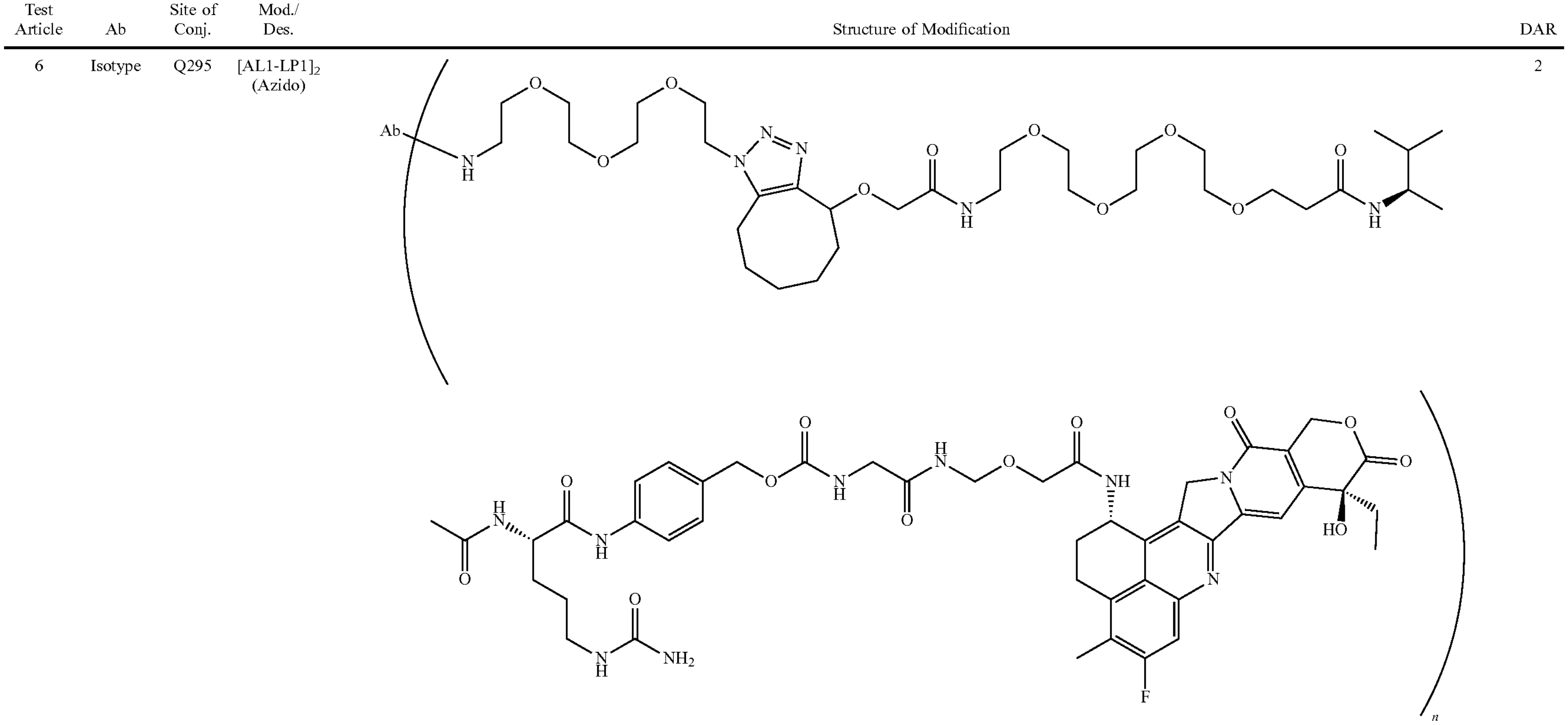 | 2 |

TABLE 17-continued
structures of ADCs according to the present disclosure
| Test Article | Ab | Site of Conj. | Mod./ Des. | Structure of Modification | DAR |
|---|---|---|---|---|---|
| 10 | Anti-HER2 | Q295 Q297 | $[AL1-LP1]_4$ (Azido) | 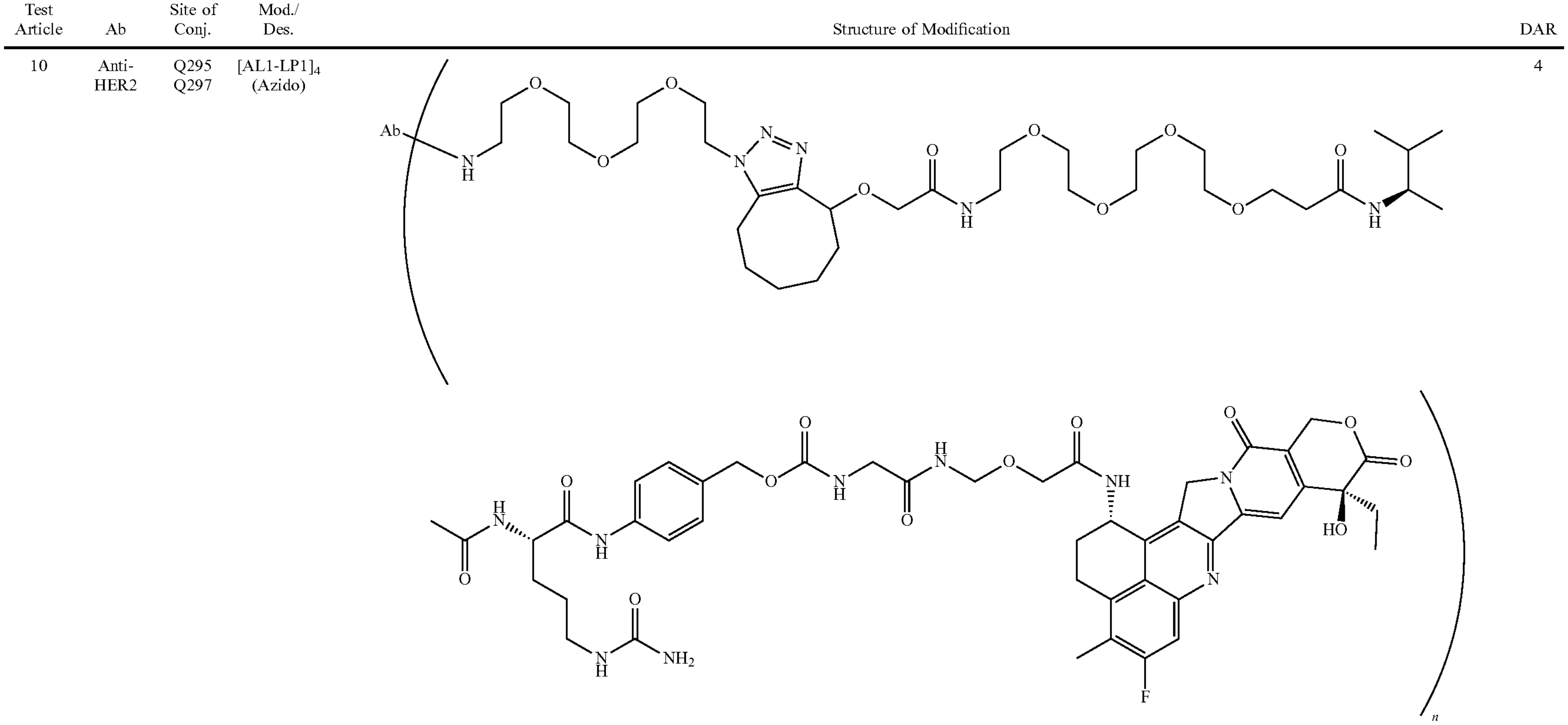 | 4 |

TABLE 17-continued
structures of ADCs according to the present disclosure
| Test Article | Ab | Site of Conj. | Mod./ Des. | Structure of Modification | DAR |
|---|---|---|---|---|---|
| 11 | Anti-HER2 | Q295 Q297 | [BL7-(LP1)$_2$]$_4$ (Branched Azido) | 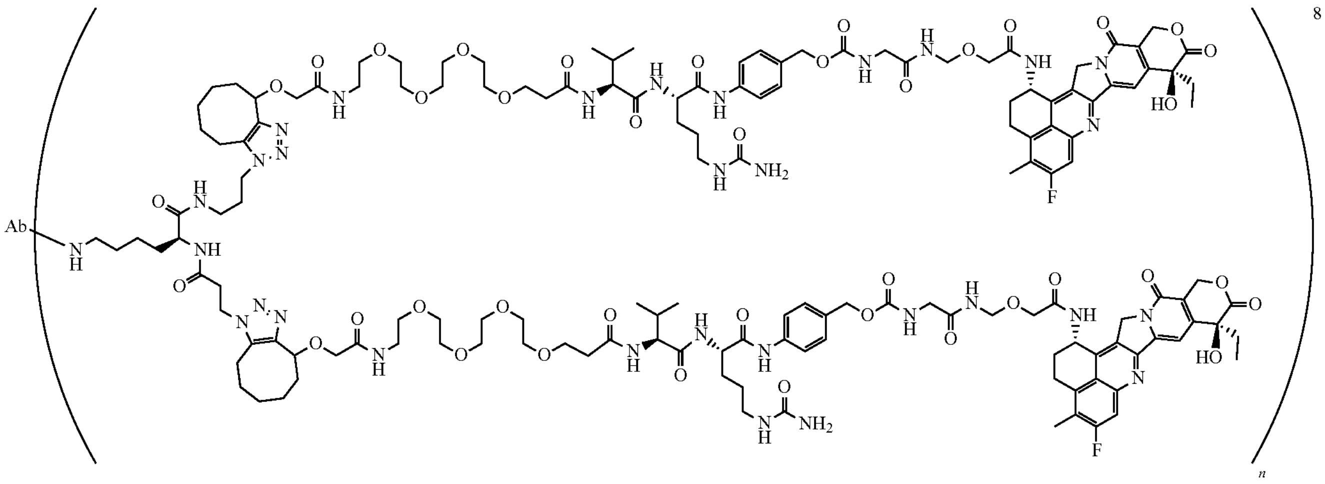 | 8 |
| BIS1 BIS2 | Anti-HER2/ HER2 bispecific | Q295 | [BL7-(LP1)$_2$]$_4$ (Branched Azido) | 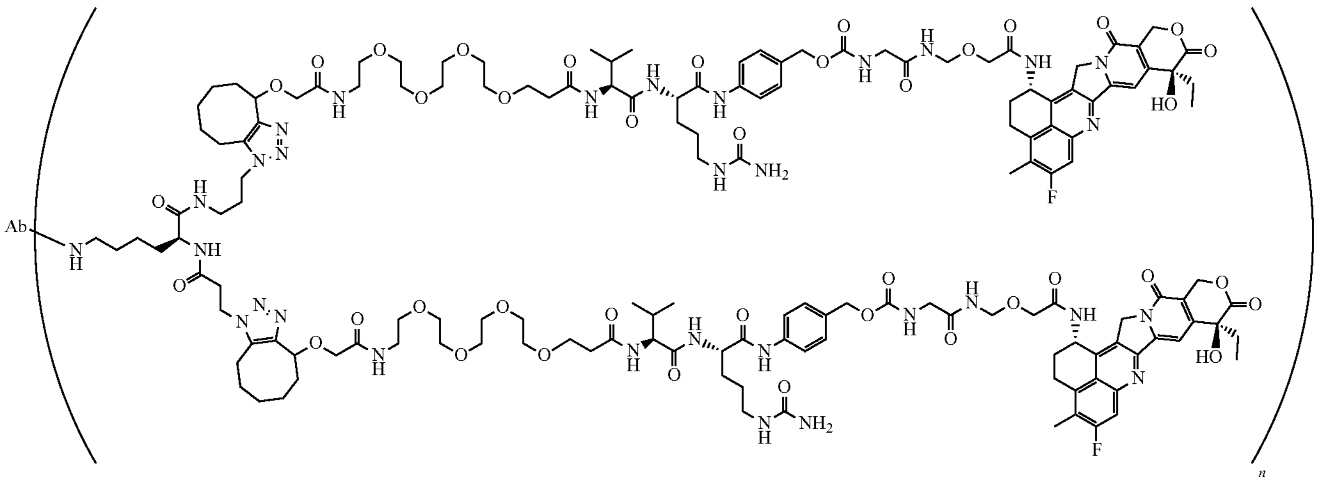 | |

TABLE 17-continued
structures of ADCs according to the present disclosure
| Test Article | Ab | Site of Conj. | Mod./Des. | Structure of Modification | DAR |
|---|---|---|---|---|---|
| 15 | Anti-STEAP2 | Q295 Q297 | [AL7-LP1]$_4$ (Azido) | 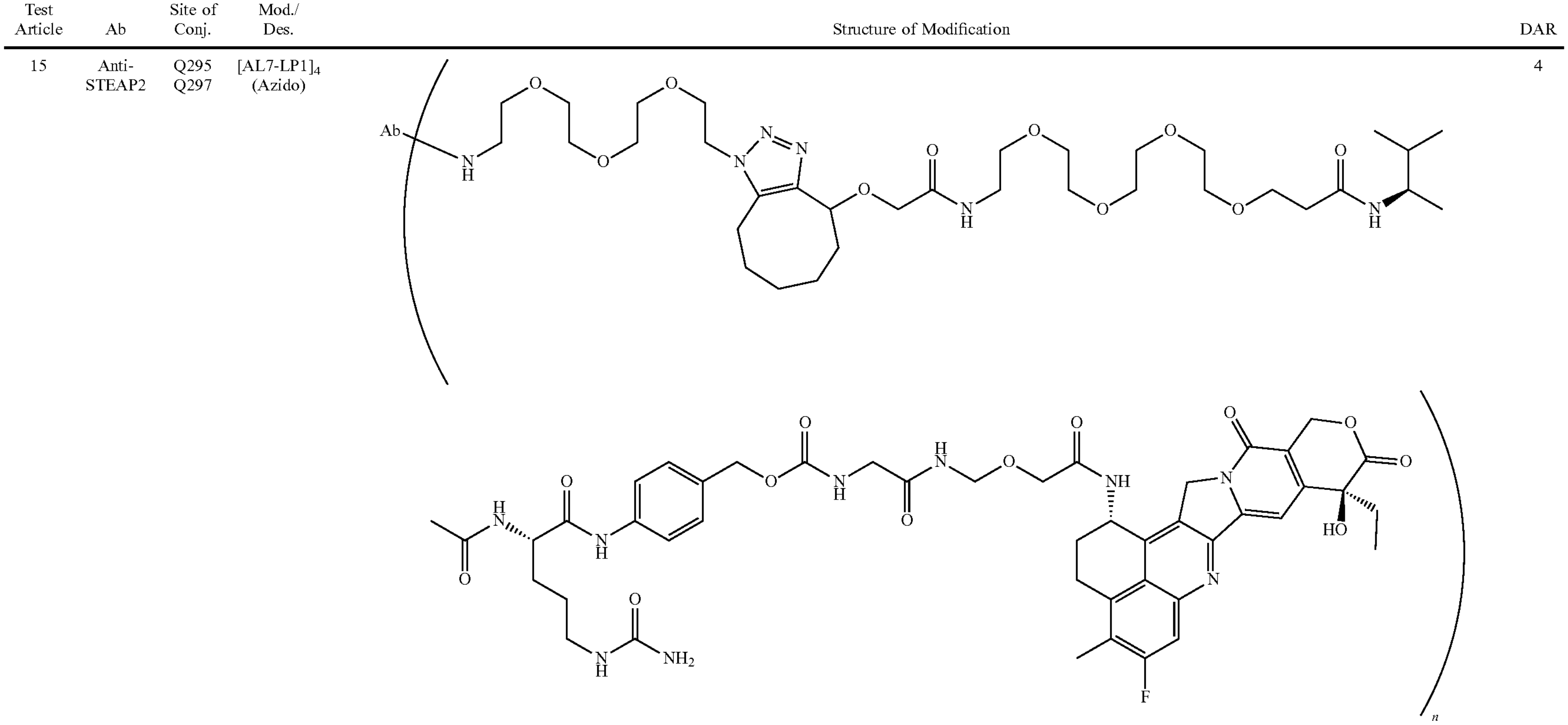 | 4 |

TABLE 17-continued
| structures of ADCs according to the present disclosure | | | | | |
|---|---|---|---|---|---|
| Test Article | Ab | Site of Conj. | Mod./ Des. | Structure of Modification | DAR |
| 16 | Anti-STEAP2 | Q295 Q297 | [BL7-(LP1)$_2$]$_4$ (Branched Azido) | 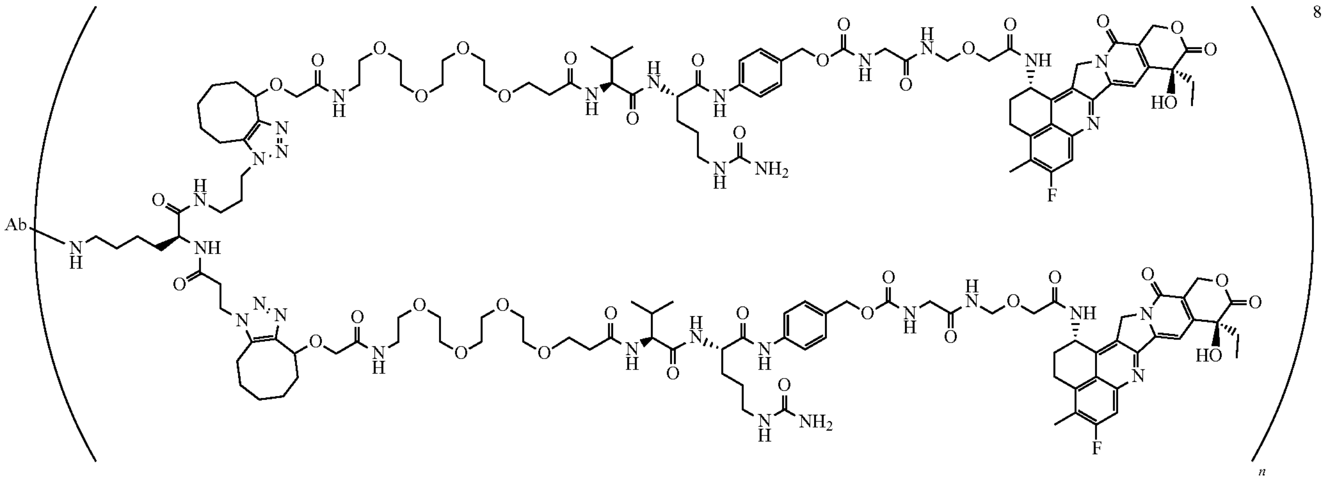 | 8 |
| 20 | Isotype Control | Q295 Q297 | [AL1-LP1]$_4$ (Azido) | 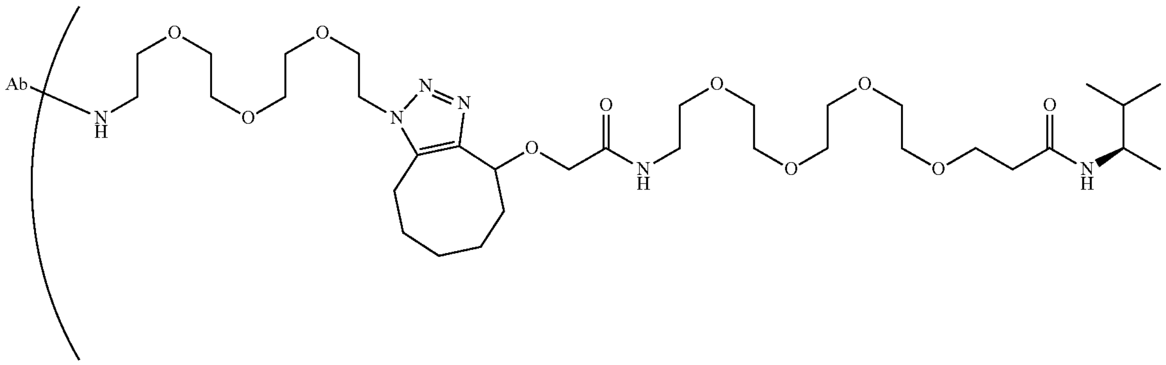 | 4 |

TABLE 17-continued
structures of ADCs according to the present disclosure
| Test Article | Ab | Site of Conj. | Mod./ Des. | Structure of Modification | DAR |
|---|---|---|---|---|---|
| | | | | 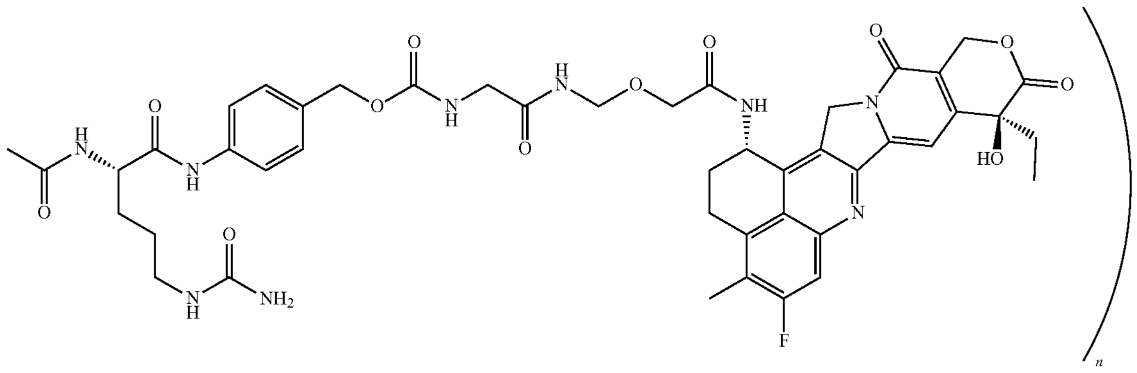 | |
| 21 | Isotype Control | Q295 Q297 | [BL7-(LP1)$_2$]$_4$ (Branched Azido) | 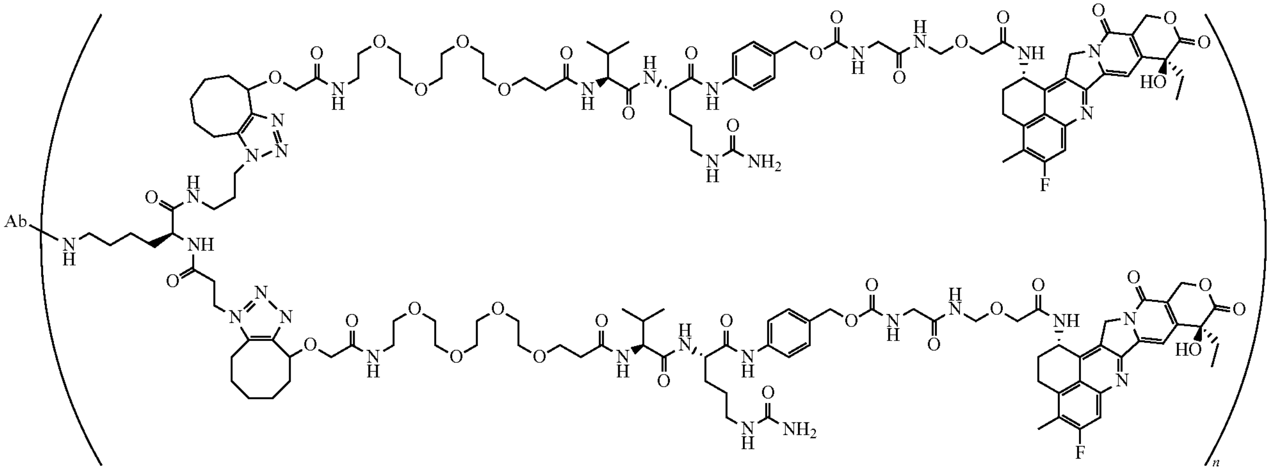 | 8 |

Table 18, below, provides the structures of ADCs generated using cysteine conjugation methods for comparison purposes.

TABLE 18

Structures of comparison ADCs

| | Ab | Mod./ Des. | Site of Conj. | Structure of Modification | DAR |
|---|---|---|---|---|---|
| 22 | Anti-HER2 | GGFG-DxD | Cys | 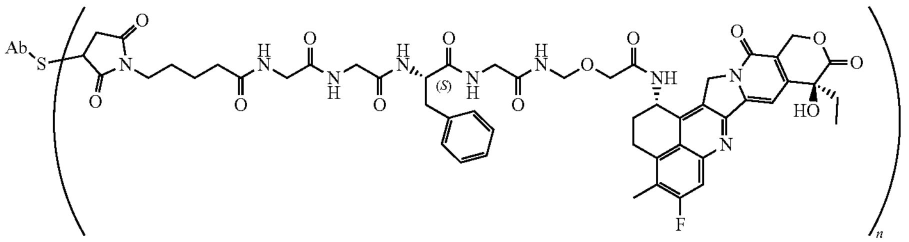 | 7.4-8.4 |
| 23 | Isotype Control | GGFG-DxD | Cys | 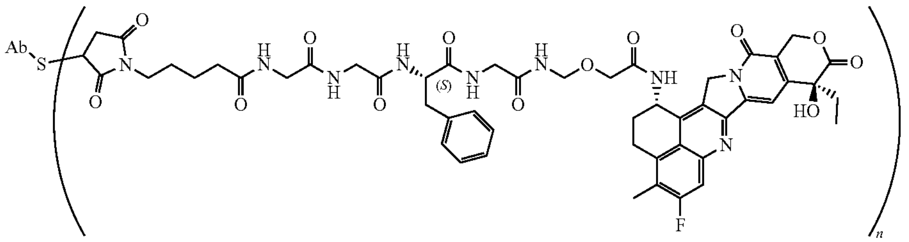 | 6.9-7.5 |

Example 20a: Step 1: Making a Site-Specific Azido-Functionalized Antibody Drug Conjugate Containing 2, 4 or 8 Azido Groups (See Table 19)

Anti-HER2 human IgG antibody containing an N297Q mutation or an isotype control antibody was mixed with 150 molar equivalents of azido-PEG3-amine (AL1, MW 218.26 g/mol) or bis azido-alkyl substituted amine (BL7, MW 325.38 g/mL). The resulting solution was mixed with transglutaminase (25 U/mL; 1 U mTG per mg of antibody, Zedira, Darmstadt, Germany) resulting in a final concentration of the antibody at 1-20 mg/mL. The reaction mixture was incubated at 25-37° C. for 4-24 hours while gently shaking while monitored by ESI-MS. Upon completion, the excess amine and mTG were removed by size exclusion chromatography (SEC) or protein A column chromatography. The conjugate was characterized by UV-Vis, SEC and ESI-MS. The azido linkers attached antibody resulting in an 804 Da or 1232 Da mass increase for the DAR=4 conjugate with AL1 and BL7 respectively. Conjugates monomer purity was >99% by SEC.

Example 20B: Step 2: Making Site-Specific Conjugates of Table 19 Via 1,3-Cycloaddition ("Click") Reactions Between Azido-Functionalized Antibodies and Alkyne Containing Linker-Payloads A site-specific antibody drug conjugate was prepared by incubating azido-functionalized antibody (1-20 mg/mL) in PBS (pH 7.4) with ≥6 molar equivalents of a linker-payload dissolved in an organic solvent such as DMSO or DMA (10 mg/mL) to have the reaction mixture containing 5-15% organic solvent (v/v), at 25-37° C. for 1-48 hours while gently shaking. The reaction was monitored by ESI-MS. Upon completion, the excess amount of linker-payload and protein aggregates were removed by size exclusion chromatography (SEC). The purified conjugate was concentrated, sterile filtered and characterized by UV-Vis, SEC and ESI-MS. Conjugates monomer purity was >99% by SEC.

Example 20C: Preparation of Anti-HER2 Ab-[AL1-LP1]$_4$ and Anti-HER2 Ab-[(BL7)-(LP1)$_2$]$_4$ In a specific example shown in FIG. 4A, aglycosylated anti-HER2 human IgG antibody containing an N297Q mutation was mixed with 150 molar equivalents of a bis azido-alkyl substituted amine (BL7, MW 325.38 g/moL). The resulting solution was mixed with microbial transglutaminase (25 U/mL; 1 U mTG per mg of antibody, Zedira, Darmstadt, Germany) resulting in a final concentration of the antibody at 8.6 mg/mL. The reaction mixture was incubated at 37° C. for 22 hours while gently shaking while monitored by ESI-MS. Upon completion, the excess amine and mTG were removed by size exclusion chromatography (SEC). The conjugate was characterized by UV-Vis, SEC and ESI-MS. The azido linkers attached antibody resulting in a 1232 Da mass increase for the DAR=4 conjugate. The site-specific antibody azido conjugate (8.6 mg/mL) in PBS (pH 7.4) was mixed with 20 molar equivalents of linker-payload (LP1) in 10 mg/mL of DMA to have the reaction mixture containing 12% organic solvent (v/v), and the solution was set at 32° C. for 36 hours while gently shaking. The reaction was monitored by ESI-MS. Upon completion, the excess amount of linker-payload and protein aggregates were removed by size exclusion chromatography (SEC). The purified conjugate was concentrated, sterile filtered and characterized by UV-Vis, SEC and ESI-MS. Conjugates monomer purity was 99.8% by SEC. The drug attached antibody resulted in a 11185 Da mass increase for the DAR=8 conjugate.

Example 20D: Preparation of Anti-HER2/HER2 Bispecific Antibody-Drug Conjugates BIS1 and BIS2-Ab-[(BL7)-$(LP1)_2]_4$ Two antibody-drug conjugates comprising an anti-HER2 bispecific antibody, where the antibody binds two distinct epitopes of HER2 were synthesized under conditions similarly described in Examples 18A-18C above to form BIS1 and BIS2 (Table 20). The two bispecific antibodies (Anti-HER2/HER2 Ab1 and Anti-HER2/HER2 Ab2) each have two binding domains binding separate epitopes of HER2. In this example, the antibodies were enzymatically deglycosylated to effect site specific azido functionalization at the two heavy chain Fc Q295 glutamine residues with the BL7 linker according to the procedure as described above. The observed DAR (based on cytotoxic agent) for the two bispecific antibody-drug conjugates BIS1 and BIS2 are provided in Table 20.

TABLE 20

Antibody Drug Conjugate DARs

| | ADC | DAR (by ESI-MS) |
|---|---|---|
| BIS1 | Anti-HER2/HER2 Ab1-[(BL7)-$(LP1)_2]_4$ | 5.2 |
| BIS2 | Anti-HER2/HER2 Ab2-[(BL7)-$(LP1)_2]_4$ | 3.8 |

Example 21: ADC Conjugation: Three Approaches

Figure 5A:
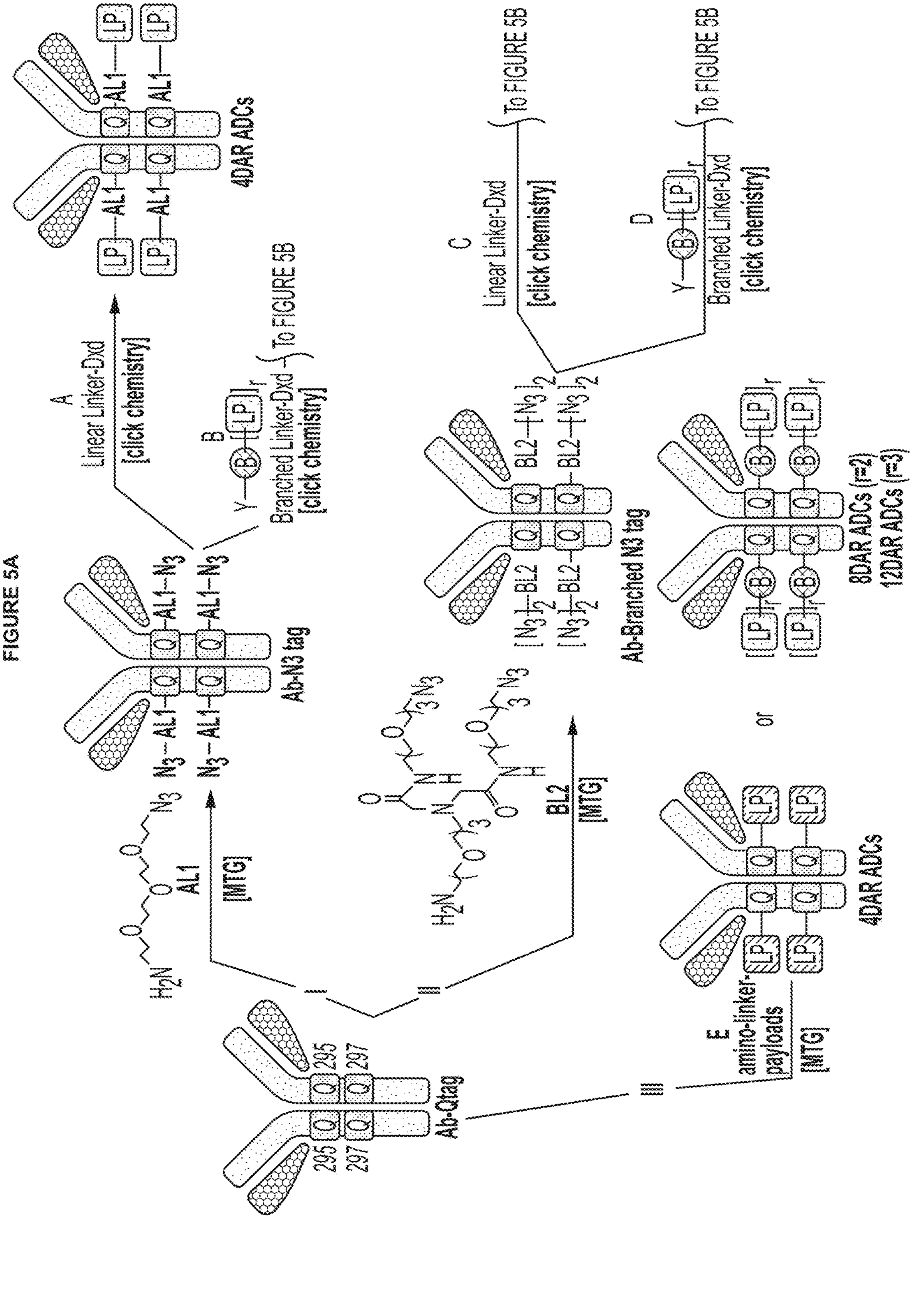
FIG. 5 is a schematic demonstrating three approaches to producing site-specific ADCs with DAR4 to DAR24 on Antibody-Q295/297 according to an embodiment of the disclosure.
Figure 5B:
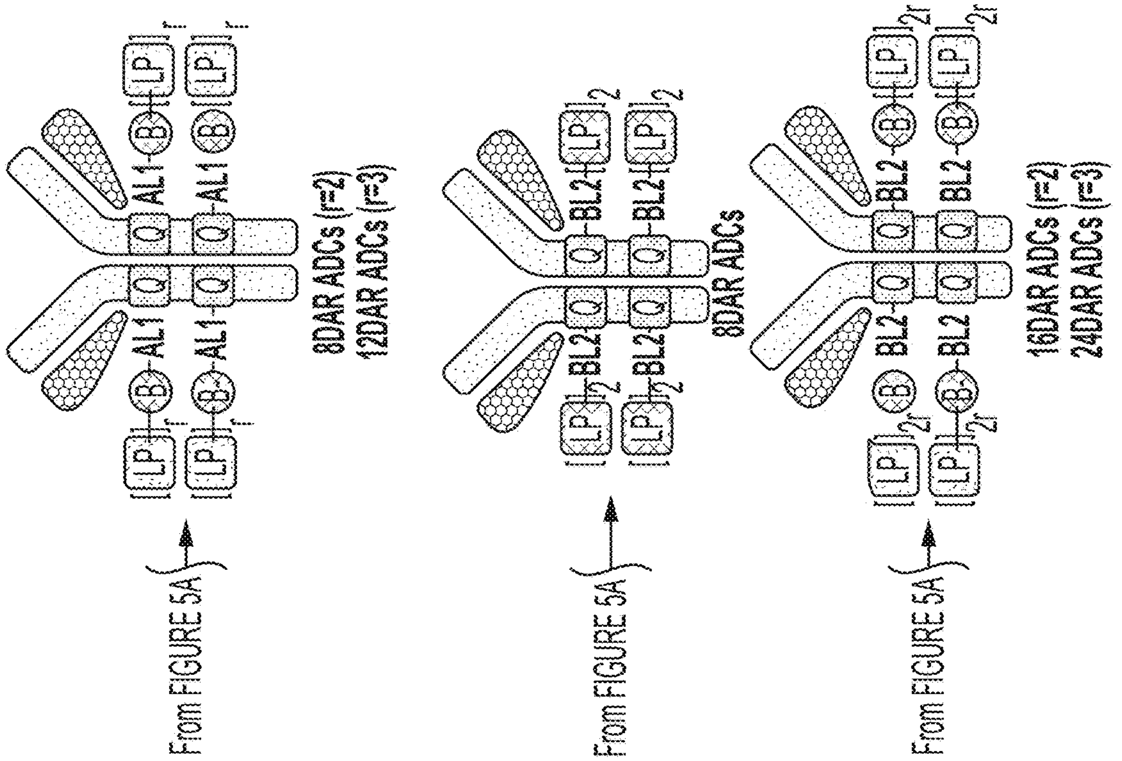
Figure 6A:
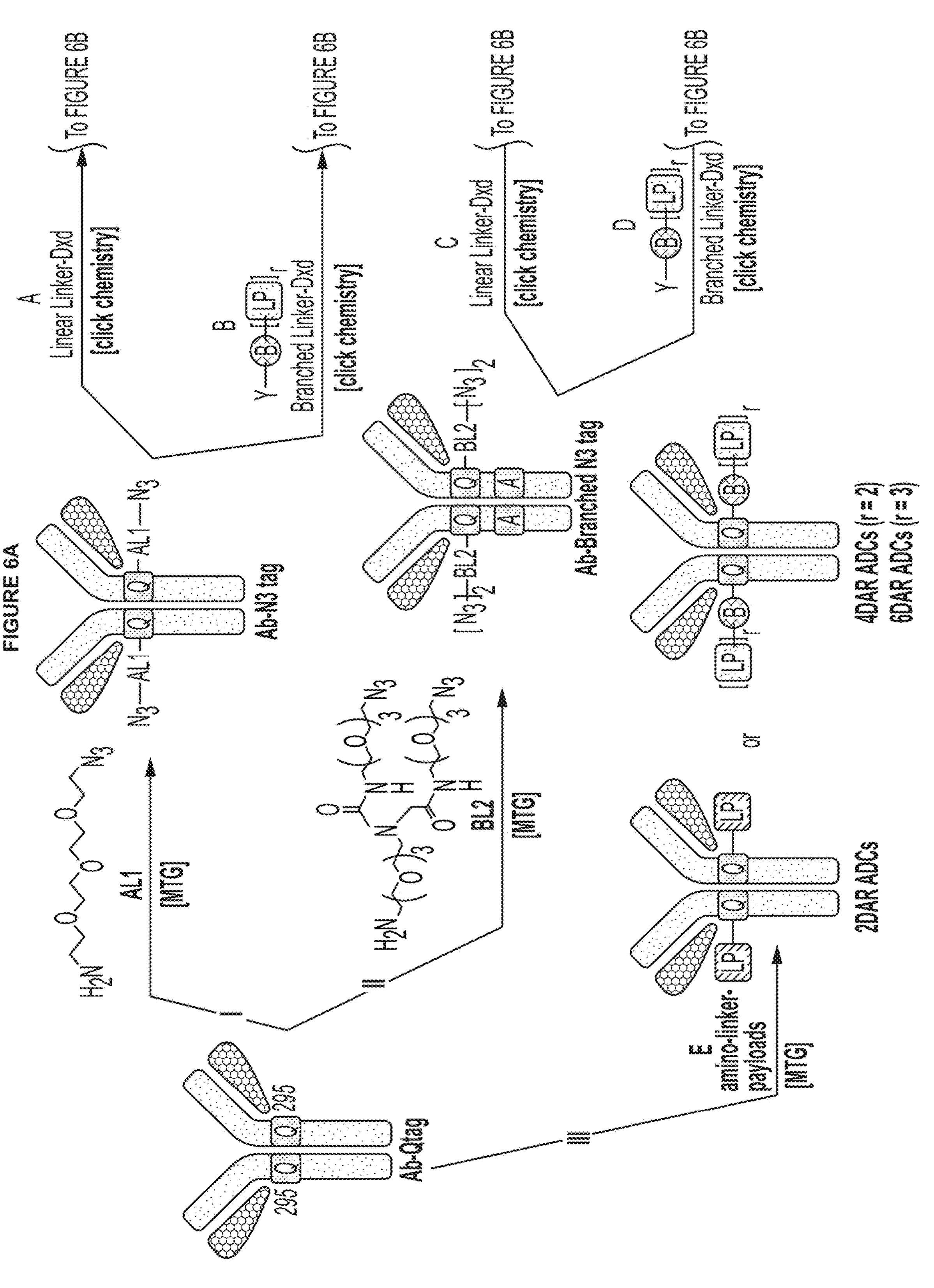
FIG. 6 is a schematic demonstrating three approaches to producing site-specific ADCs with DAR2 to DAR12 on Antibody-Q295 according to an embodiment of the disclosure.
Figure 6B:
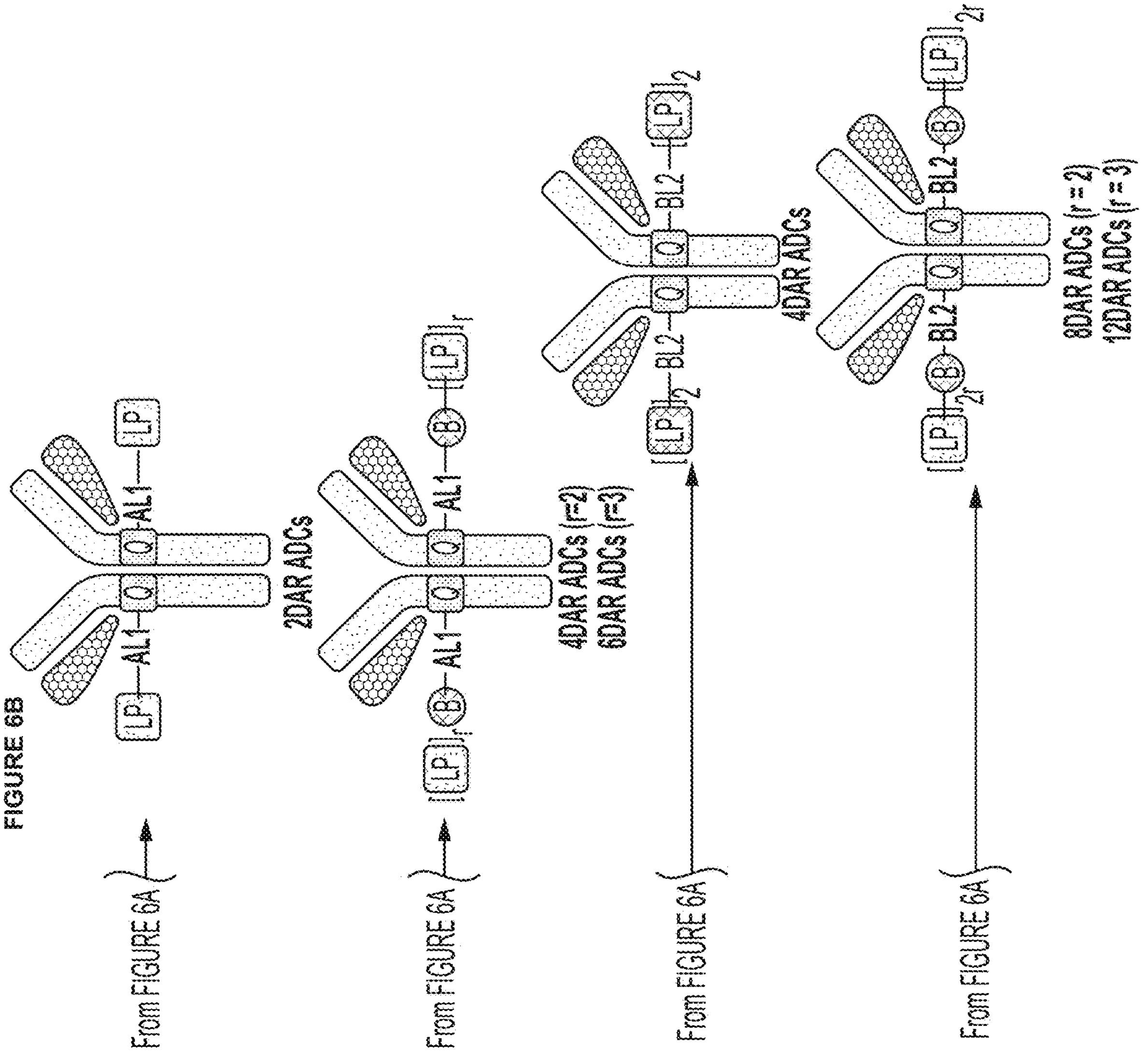

The site-specific ADC conjugations on antibody Q295/297 sites to generate DAR4 to DAR24 ADCs are depicted in FIG. 5 and on antibody Q295 sites to generate DAR2 to DAR12 ADCs are depicted in FIG. 6. The present disclosure depicts three exemplary approaches to attach branched linker-payloads to antibody Q295/297 sites.

Approaches I and II include a two-step process for the antibody-drug conjugations. The first step is microbial transglutaminase (MTG) mediated attachment of a small molecular amine, e.g., AL1 or BL2, to the mAb-Q sites, wherein an excess of the amine reagent is used to avoid potential cross-linking of antibody chains (WO2017/147542, incorporated by reference herein in its entirety). The second step is attaching an alkyne-linked linker payload ($L_2P$) to the $N_3$-tagged conjugate via, e.g., a strain-promoted azide-alkyne cycloaddition (SPAAC, aka copper-free click chemistry). Where the reactive group (RG) is a DIBAC or COT moiety, the conjugation is carried out with an azido functionalized antibody via a [2+3] cycloaddition. This process provides the site-specific and stoichiometric conjugates. The number of $L_2P$ molecules added to the antibody is dependent on the number of conjugation sites and the number of azide functional groups (n) within $L_1$ (e.g., for AL, n=1; for BL, n 2).

Approach I is to conjugate a small molecular amine linker L1 (e.g., AL1) to the antibody Q295/297 sites to generate antibody-azido tag (Ab-N3), which is then covalently reacted (e.g., via the "click" cycloaddition) with an alkyne-tethered linear linker-payload (LL2P) to generate 4DAR ADCs (method A in FIG. 5) and with an alkyne tethered branched linker-payload (BL2P) to generate 8DAR ADCs (method B in FIG. 5).

Approach II is to conjugate a small molecular branched azido-amine (e.g., BL2) to the antibody Q295/297 sites to generate antibody branched-azido tag (Ab-branch-2N3), which is then covalently reacted (e.g., via the "click" cycloaddition) with a linear linker-Payload to generate 8DAR ADCs (method C in FIG. 5) and with an alkyne tethered branched linker-2 Payload to generate 16DAR ADCs or a branched tethered-3 Payload to generate 24DAR ADCs (method D in FIG. 5). Similarly, the site-specific ADC conjugations on antibody Q295 sites with the linear or branched linker-Payload could generate DAR2 to DAR12 ADCs (FIG. 6).

In the conjugations of Approach III, the MTG mediated attachment of an amine-branched linker-payload to the antibody Q295/297 sites was achieved using ≥20 molar equivalents of the amine reagents in a single step MTG-mediated reaction.

For antibodies with a WT Fc domain that were enzymatically deglycosylated or have an N297D Fc mutation and then azido functionalized with AL or BL linkers, the expected DAR per azido-tag on 2 Fc=2n. For antibodies with an N297Q Fc mutation which were azido-functionalized with AL or BL linkers, the expected DAR per azido-tag on 2 Fc=4n. For antibodies conjugated with each linker-Payload having m×payload ($P_m$), the expected ADC-DAR=(2n×m) for N297D mutated antibodies (FIG. 6) and (4n×m) for N297Q mutated antibodies (FIG. 5).

All ADCs conjugated via 2-steps conjugations (methods A, B, C, D in FIG. 5) were summarized in Table 21 and the ADCs conjugated via 1-step conjugations (methods E in FIG. 5) were summarized in Table 22.

Generic Procedures for Making Site-Specific Conjugates in Two Steps

Example 21a: Step 1: Making a Site-Specific Azido-Functionalized Antibody Drug Conjugate Containing 2, 4 or 8 Azido Groups Aglycosylated human antibody IgG (IgG1, IgG4, etc.) containing an N297Q mutation or N297D mutation in BupH buffer (pH7.4) was mixed with >=150 molar equivalents of azido-PEG3-amine (AL1) or bis azido-alkyl substituted amine (BL2). The resulting solution was mixed with transglutaminase (25 U/mL; 1 U mTG per mg of antibody, Zedira, Darmstadt, Germany; or 10 U/mL; 5.5 U MTG per mg of antibody, Modernist Pantry-ACTIVA TI contains Maltodextrin from Ajinomoto, Japan) resulting in a final concentration of the antibody at 0.5-20 mg/mL. The reaction mixture was incubated at 25-37° C. for 24 hours while gently shaking while monitored by ESI-MS. Upon completion, the excess amine and mTG were removed by size exclusion chromatography (SEC) or protein A column chromatography. The conjugate was characterized by UV-Vis, SEC and ESI-MS. The azido linkers attached to the antibody resulted in an 804 Da or 1232 Da mass increase for the 4DAR conjugates with AL1 and BL2, respectively, and in a 2768 Da increase for the 8DAR antibody-BL2-(azide)8 conjugate. Conjugates' monomer purity was >99% by SEC.

Example 21B: Step 2: Making Site-Specific Conjugates Via [2+3] Click Reactions Between Azido-Functionalized Antibodies and an Alkyne Containing Linker-Payload A site-specific antibody drug conjugate with a human IgG (IgG1, IgG4, etc) was prepared by the [2+3] azide-alkyne "click" reaction between the azido-functionalized antibody and an alkyne-functionalized linker-payload. The azido-functionalized antibody (1-20 mg/mL) in PBS (pH7.4) was incubated with ≥6 molar equivalents of a linker-payload (LP) dissolved in an organic solvent such as DMSO or DMA (10 mg/mL) to have the reaction mixture containing 5-15% organic solvent (v/v) at 25-37° C. for 1-48 hours while gently shaking. The reaction was monitored by ESI-MS. Upon completion, the excess amount of LP and organic solvent were removed by desalting column with BupH (pH 7.4) and protein aggregates (if any) were removed by size exclusion chromatography (SEC). The purified conjugate was concentrated, sterile filtered and characterized by UV-Vis, SEC and ESI-MS. Conjugates' monomer purity was >99% by SEC.

Figure 7A:
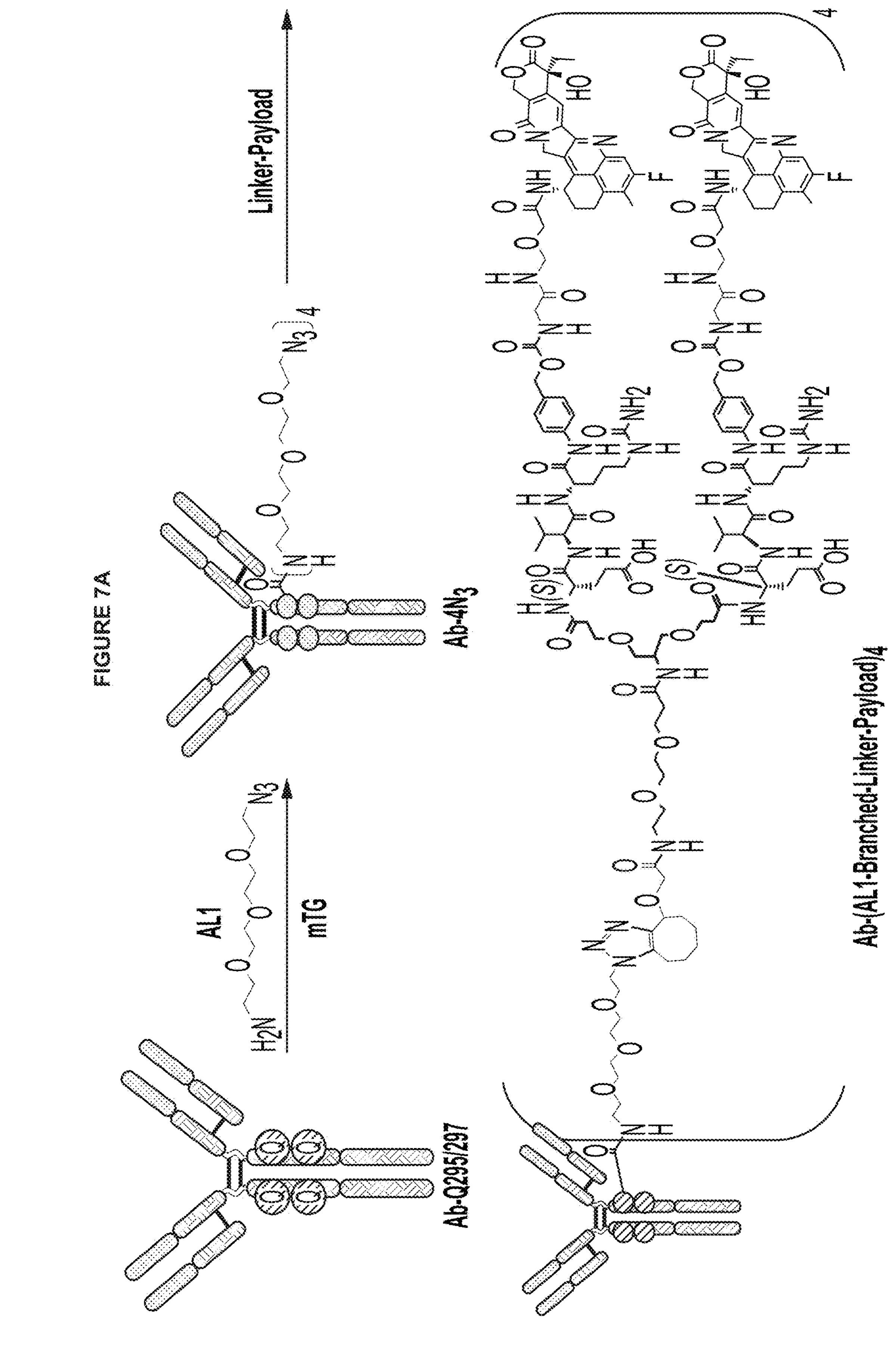
FIG. 7A is a schematic demonstrating two-step Approach I for making an exemplary 8DAR Branch-Linker-Payload ADC (Ab-AL1-LP39).

Example 21C: A Representative 8DAR ADC from Approach I is Exemplified with Ab-LP39 ADC (FIG. 7A)

The aglycosylated anti-Her2 human IgG antibody containing an N297Q mutation was mixed with >200 molar equivalents of a azido-dPEG3-amine (AL1, MW 218.26 g/moL). The resulting solution was mixed with microbial transglutaminase (10 U/mL; 5.5 U mTG per mg of antibody, Modernist Pantry-ACTIVA TI contains Maltodextrin from Ajinomoto, Japan) resulting in a final concentration of the antibody at 5 mg/mL. The reaction mixture was incubated at 37° C. for 24 hours while gently shaking while monitored by ESI-MS. Upon completion, the excess amine and mTG were removed by size exclusion chromatography (SEC). The conjugate was characterized by UV-Vis, SEC and ESI-MS. The azido linkers attached to the antibody resulted in a 808 Da mass increase, indicating that 4 AL1s with 4 azido tags were conjugated to the antibody (Ab-4AL1). This site-specific antibody azido conjugate (2.1 mg/mL) in PBS (pH7.4) was mixed with 15 molar equivalents of linker-payload (LP39) in 2 mM of DMSO to have the reaction mixture containing 5% organic solvent (v/v), and the solution was set at 32° C. for 36 hours while gently shaking. The reaction was monitored by ESI-MS. Upon completion, the excess amount of linker-payload and protein aggregates were removed by size exclusion chromatography (SEC). The purified conjugate was concentrated, sterile filtered and characterized by UV-Vis, SEC and ESI-MS. Conjugate's monomer purity was 99.8% by SEC. The drug attached to the antibody resulted in a 11003 Da mass increase for the DAR8 conjugate, indicating that 8 LPs were conjugated to the antibody.

Figure 7B:
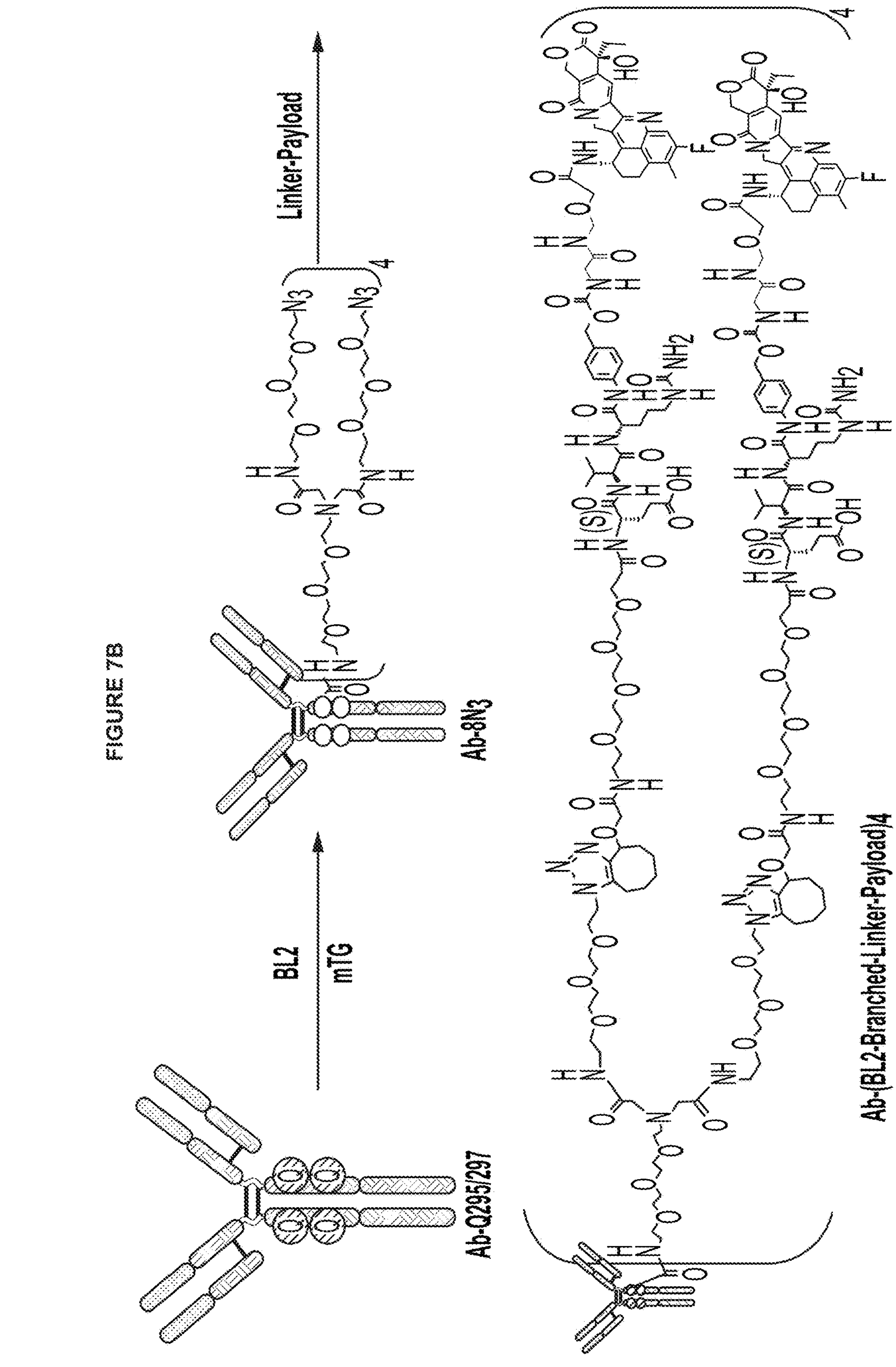
FIG. 7B is a schematic demonstrating two-step Approach II for making an exemplary 8DAR Branch-Linker-Payload ADC (Ab-BL2-LP22).

Example 21D: A representative 8DAR ADC from Approach I is Exemplified with Ab-LP22 ADC (FIG. 7B)

The aglycosylated anti-Her2 human IgG antibody containing an N297Q mutation was mixed with >200 molar equivalents of BL2 (MW=708.8 g/mol). The resulting solution was mixed with microbial transglutaminase (10 U/mL; 5.5 U mTG per mg of antibody, Modernist Pantry-ACTIVA TI contains Maltodextrin from Ajinomoto, Japan) resulting in a final concentration of the antibody at 5 mg/mL. The reaction mixture was incubated at 37° C. for 24 hours while gently shaking. Upon the completion, the excess amine and MTGase were removed by size exclusion chromatography (SEC). The conjugate was characterized by UV-Vis, SDS-PAGE, SEC and ESI-MS. Conjugate's monomer purity was 96.11% by SEC. The azido linkers attached to the antibody resulted in a 2768 Da mass increase, indicating 4 BL2 was conjugated to the antibody (Ab-2BL2) with 8 azido tags. The site-specific antibody azido conjugate (1.492 mg/mL) in BupH (pH7.4) was mixed with 15 molar equivalents of linker-payload (LP22) in 2 mM of DMSO to have the reaction mixture containing 5% organic solvent (v/v), and the solution was set at 25° C. for 72 hours while gently shaking. The reaction was monitored by SDS-PAGE. Upon completion, the excess amount of linker-payload was removed by desalting column with BupH (pH 7.4). The drug attached to the antibody conjugate showed a 12200 Da mass increase for the DAR8 conjugate, indicating that 8 LPs were conjugated to the antibody.

An exemplary branched azide reagent BL12 used in the conjugation in Approach II is depicted below.

BL12

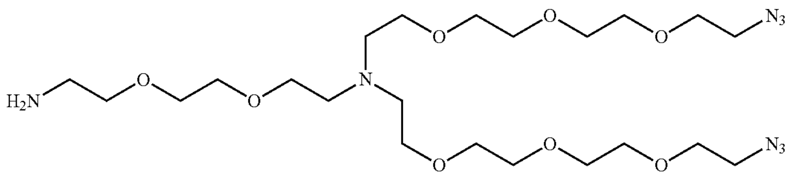

Example 21E: Generic Procedures for Making Site-Specific Conjugates in One Step Aglycosylated human antibody IgG (IgG1, IgG4, etc.) in BupH buffer (pH7.4) is mixed with 15-30 molar equivalents of amino-linker-payload. The resulting solution is mixed with MTG (Modernist Pantry-ACTIVA TI contains Maltodextrin from Ajinomoto, Japan) (10 U/mL; 5.5 U MTG per mg of antibody) resulting in a final concentration of the antibody at 0.5-5 mg/mL, and the solution was then incubated at 37° C. for 24 h while gently shaking. Upon reaction completion, the excess amine and MTG are removed by Size Exclusion Chromatography (SEC) to generate the directly conjugated Linker-Payload ADC. This product is concentrated by ultra centrifugation and characterized by SDS-PAGE, SEC and LC-MS. The MS results of the ADC included an additional mass increase of 4×LP conjugate, indicating 4DAR ADC, or an additional mass increase of 8×LP conjugate, indicating 8DAR ADC.

Figure 7C:
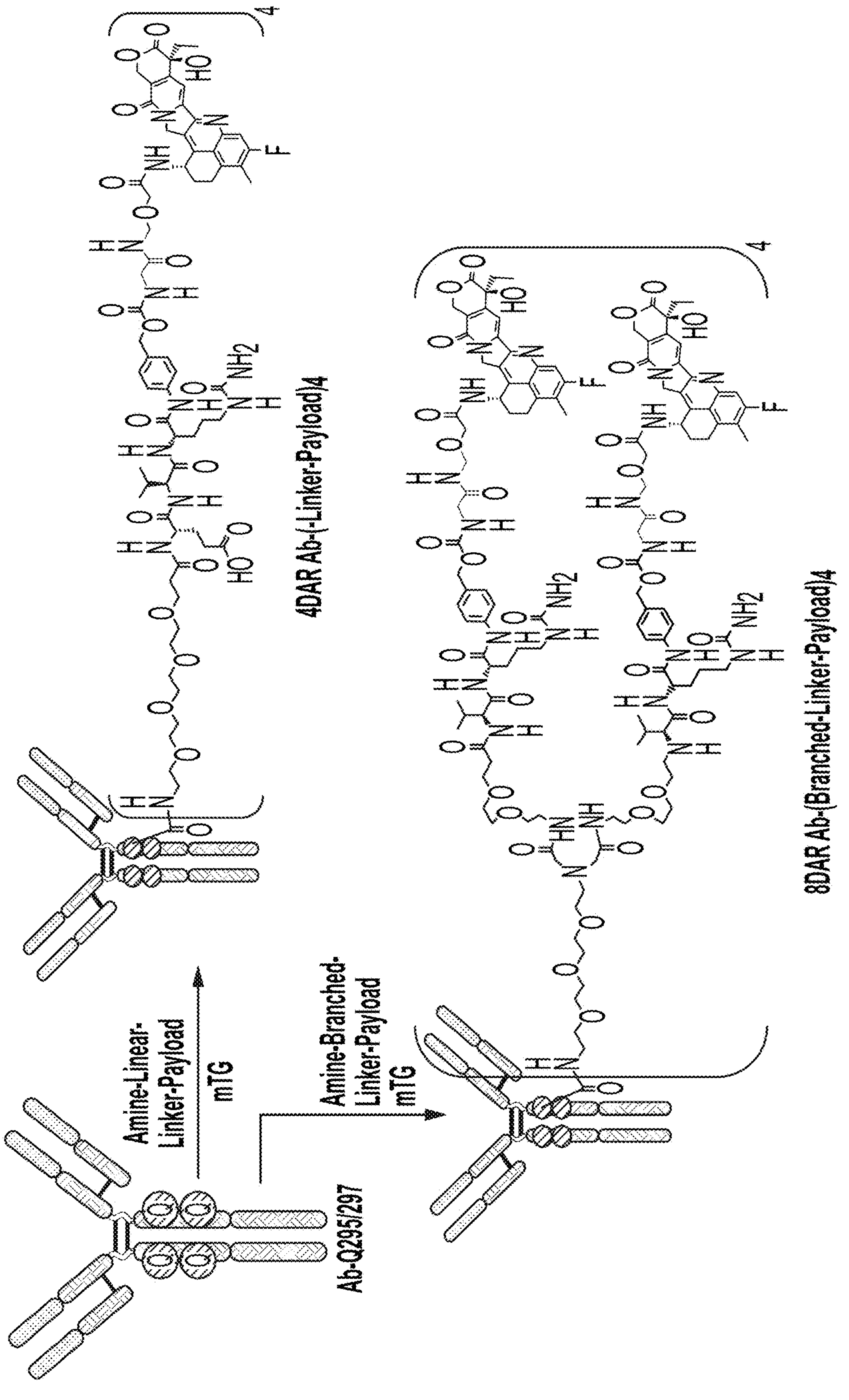
FIG. 7C is a schematic demonstrating one-step Approach III for making 4DAR ADC with Linear-Linker-P and 8DAR ADC with Branch-Linker-Payload.

Example 21F: a Representative 4DAR ADC from Approach III Exemplified by Ab-LP21 ADC, which was Conjugated from One Step Conjugation of an Antibody with a with Linear-Linker-Payload (FIG. 7C)

In a specific example, the aglycosylated antibody (1 mg) in 0.5 mL BupH (pH 7.4) was treated with 30 molar equivalents of LP08 (conc. 20 mM in DMSO). The resulting solution is mixed with MTG (Modernist Pantry-ACTIVA TI contains Maltodextrin from Ajinomoto, Japan) (10 U/mL; 5.5 U MTG per mg of antibody) resulting in a final concentration of the antibody at 5 mg/mL, and the solution was then incubated for 24 hours at 37° C. while gently shaking.

Upon reaction completion, the excess linker payload (LP) was removed by Size Exclusion Chromatography (SEC, Superdex® 200 Increase 10/300 GL). This product is concentrated by ultra-centrifugation and characterized by SDS-PAGE, SEC and LC-MS. Conjugate's monomer purity was 98.8% by SEC. The amino-linker-payload added to four sites of the antibody resulting in a 5380 Da increase for the 4DAR antibody-LP conjugate.

Example 21G: a Representative 8DAR ADC from Approach III Exemplified with Ab-LP27 ADC (FIG. 7C), which was Conjugated from One Step Conjugation of an Antibody with a Branched Linear-Linker-Payload Using the same method described for the one step conjugation for making 4DAR ADC (Example 21F), an amino-branched linker-payload (LP27) was conjugated to four sites of the antibody, resulting in a 10187.2 Da increase for the 8DAR conjugate.

TABLE 21

ADCs conjugated from 2-steps (methods A, B, C, D in FIG. 5) for targeting Her2, FGFR2, and non-binding control

| Linker-payload | | ADC | | SKBR3 |
|---|---|---|---|---|
| LP# | Name | ADC code # | DAR | $EC_{50}$ (nM) |
| | None | Anti-Her2 | | NA |
| | None | Anti-Her2-AL1 | | NA |
| | None | Anti-Her2-BL2 | | NA |
| LP9 | COT-GGFG-NHCH2-Dxd | Anti-Her2-AL1-LP9 | 4.00 | 0.61 |
| LP4 | DIBAC-GGFG-NHCH2-Dxd | Anti-Her2-AL1-LP4 | 3.68 | 0.60 |
| LP3 | COT-GGGG-NHCH2-Dxd | Anti-Her2-AL1-LP3 | — | — |
| LP1 | COT-PEG4-vcPAB-G-NHCH2-Dxd | Anti-Her2-AL1-LP1 | 4.00 | 0.38 |
| LP1 | COT-PEG4-vcPAB-G-NHCH2-Dxd | Control-AL1-LP1 | 4.00 | 285.97 |
| LP1 | COT-PEG4-vcPAB-G-NHCH2-Dxd | Anti-Her2-BL2-LP1 | 8.00 | 0.38 |
| LP2 | DIBAC-PEG4-vcPAB-G-NHCH2-Dxd | Anti-Her2-AL1-LP2 | 4.00 | 0.40 |
| LP2 | DIBAC-PEG4-vcPAB-G-NHCH2-Dxd | Control -AL1-LP2 | 4.00 | >500.00 |
| LP20 | COT-PEG4-$^{D}$EvcPAB-G-NHCH2-Dxd | Anti-Her2-AL1-LP20 | 4.00 | 0.36 |
| LP20 | COT-PEG4-$^{D}$EvcPAB-G-NHCH2-Dxd | Control -AL1-LP20 | 4.00 | 182.57 |
| LP22 | COT-PEG4-$^{L}$EvcPAB-G-NHCH2-Dxd | Anti-Her2-AL1-LP22 | 3.97 | 0.05 |
| LP22 | COT-PEG4-$^{L}$EvcPAB-G-NHCH2-Dxd | Control -AL1-LP22 | 4.00 | >266.00 |
| LP22 | COT-PEG4-$^{L}$EvcPAB-G-NHCH2-Dxd | Anti-Her2-BL2-LP22 | 8.00 | 0.42 |
| LP10 | COT-PAB(GLCA)-G-NHCH2-Dxd | Anti-Her2-AL1-LP10 | 4.00 | 0.35 |
| LP11 | COT-PAB(GLC)-G-NHCH2-Dxd | Anti-Her2-AL1-LP11 | 4.00 | 0.61 |
| LP12 | COT-PAB(GLCA)-GG-NHCH2-Dxd | Anti-Her2-AL1-LP12 | 4.00 | 0.30 |
| LP23 | COT-PEG4-CO-B1-(LP1)(LP2) | Anti-Her2-AL1-LP23 | 7.22 | 0.90 |
| LP23 | COT-PEG4-CO-B1-(LP1)(LP2) | Control -AL1-LP23 | 6.74 | >500.00 |
| LP24 | COT-B2-[NH-PEG2-vcPAB-G-NHCH2-Dxd]2 | Anti-Her2-AL1-LP24 | 4.24 | 0.36 |
| LP24 | COT-B2-[NH-PEG2-vcPAB-G-NHCH2-Dxd]2 | Control -AL1-LP24 | 5.86 | 739.11 |
| LP25 | COT-B2-[NH-PEG2-$^{D}$EvcPAB-G-NHCH2-Dxd]2 | Anti-Her2-AL1-LP25 | 8.00 | 0.25 |
| LP26 | DIBAC-suc-B2-[NH-PEG4-vcPAB-G-NHCH2-Dxd]2 | Anti-Her2-AL1-LP26 | 8.00 | 0.44 |
| LP28 | COT-B3-[NH-PEG2-$^{D}$EvcPAB-G-NHCH2-Dxd]2 | Anti-Her2-AL1-LP28 | 8.00 | 0.36 |
| LP28 | COT-B3-[NH-PEG2-$^{D}$EvcPAB-G-NHCH2-Dxd]2 | Control -AL1-LP28 | 7.18 | 504.39 |
| LP28 | COT-B3-[NH-PEG2-$^{D}$EvcPAB-G-NHCH2-Dxd]2 | Anti-Her2-BL2-LP28 | 11.21 | 0.26 |
| LP30 | DIBAC-suc-B3-[NH-PEG2-$^{D}$EvcPAB-G-NHCH2-Dxd]2 | Anti-Her2-AL1-LP30 | 8.00 | 0.50 |
| LP32 | COT-B3-[NH-PEG2-$^{L}$EvcPAB-G-NHCH2-Dxd]2 | Anti-Her2-AL1-LP32 | 6.95 | 0.19 |

TABLE 21-continued

ADCs conjugated from 2-steps (methods A, B, C, D in FIG. 5) for targeting Her2, FGFR2, and non-binding control

| Linker-payload | | ADC | | |
|---|---|---|---|---|
| | | | | SKBR3 |
| LP# | Name | ADC code # | DAR | $EC_{50}$ (nM) |
| LP32 | COT-B3-[NH-PEG2-$^{L}$EvcPAB-G-NHCH2-Dxd]2 | Anti-Her2-BL2-LP32 | 11.55 | 0.51 |
| LP34 | DIBAC-suc-B3-[NH-PEG2-$^{L}$EvcPAB-G-NHCH2-Dxd]2 | Anti-Her2-AL1-LP34 | 8.00 | 0.40 |
| LP35 | COT-B3-[NH-PEG2-GGFG-NHCH2-Dxd]2 | Anti-Her2-AL1-LP35 | | |
| LP36 | COT-B4-[NH-PEG2-$^{D}$EVCPAB-G-NHCH2-Dxd]2 | Anti-Her2-AL1-LP36 | 8.00 | 0.19 |
| LP37 | COT-B4-[NH-PEG2-$^{L}$EVCPAB-G-NHCH2-Dxd]2 | Anti-Her2-AL1-LP37 | | |
| LP38 | COT-PEG2-B4-[NH-PEG2-$^{L}$EVCPAB-G-NHCH2-Dxd]2 | Anti-Her2-AL1-LP38 | 7.23 | 0.46 |
| LP38 | COT-PEG2-B4-[NH-PEG2-$^{L}$EVCPAB-G-NHCH2-Dxd]2 | Anti-Her2-BL2-LP38 | 14.16 | 0.36 |
| LP39 | COT-PEG2-B4-[NH-LEVCPAB-G-NHCH2-Dxd]2 | Anti-Her2-AL1-LP39 | 8.00 | 0.72 |
| LP39 | COT-PEG2-B4-[NH-LEVCPAB-G-NHCH2-Dxd]2 | Anti-Her2-BL2-LP39 | 15.80 | 0.39 |
| LP41 | COT-PEG2-B5-[NH-PEG2-LEVCPAB-G-NHCH2-Dxd]3 | Anti-Her2-AL1-LP41 | | |
| LP41 | COT-PEG2-B5-[NH-PEG2-LEVCPAB-G-NHCH2-Dxd]3 | Anti-Her2-BL2-LP41 | | |
| | None | FGFR2b-1-BL12 | | |
| LP1 | | FGFR2b-1-BL12-LP1 | 7.8 | |
| LP1 | | FGFR2b-1-AL1-LP1 | 4 | |
| LP35 | | FGFR2b-1-AL1-LP35 | 7.8 | |
| LP32 | | FGFR2b-1-AL1-LP32 | 7.4 | |
| LP39 | | FGFR2b-1-AL1-LP39 | 7.5 | |
| LP38 | | FGFR2b-1-AL1-LP38 | 7.2 | |
| LP2 | | FGFR2b-1-BL12-LP2 | | |
| LP1 | | Control-AL1-LP1 | 4 | |
| LP35 | | Control-AL1-LP35 | 7.7 | |
| LP32 | | Control-AL1-LP32 | 7.3 | |
| LP39 | | Control-AL1-LP39 | 7.6 | |
| LP38 | | Control-AL1-LP38 | 7.2 | |

TABLE 22

ADCs conjugated from 1-step (method E in FIG. 5)

| Linker-payload | | ADC | | |
|---|---|---|---|---|
| | | | | SKBR3 $EC_{50}$ |
| LP# | Name | ADC Code # | DAR | (nM) |
| LP16 | NH2-PEG4-vcPAB-G-NHCH2-Dxd | Anti-HER2-LP16 | | |
| LP21 | NH2-PEG4-$^{L}$EvcPAB-G-NHCH2-Dxd | Anti-HER2-LP21 | 3.83 | 0.26 |
| LP27 | NH2-B3-[NH-PEG2-vcPAB-G-NHCH2-Dxd]2 | Anti-HER2-LP27 | | |

TABLE 22-continued

ADCs conjugated from 1-step (method E in FIG. 5)

| Linker-payload | | ADC | | |
|---|---|---|---|---|
| | | | | SKBR3 $EC_{50}$ |
| LP# | Name | ADC Code # | DAR | (nM) |
| LP31 | NH2-B3-[NH-PEG2-$^{L}$EvcPAB-G-NHCH2-Dxd]2 | Anti-HER2-LP31 | | |
| qLP18 | NH2-PEG3-TCOT-PEG4-vcPAB-Gly-NHCH2-Dxd | Anti-HER2-qLP18 | | |

Example 21H: a Representative Procedure for Step 1: Making a Site-Specific Azido-Functionalized Antibody Drug Conjugate Containing 8 Azido Groups Using Branched (BL) Linkers (Table 23)

Anti-Her2 human IgG antibody containing an N297Q mutation or isotype control antibody was mixed with 20-100 molar equivalents of bis azido-alkyl substituted amine (BL2, MW 708.82 g/mL or BL12, MW 550.66). The resulting solution was mixed with transglutaminase (1 U mTG per mg of antibody, Millipore-Sigma) resulting in a final concentration of the antibody at 1-20 mg/mL. The reaction mixture was incubated at 25-37° C. for 4-24 hours while gently shaking while monitored by ESI-MS. Upon completion, the excess amine and mTG were removed by size exclusion chromatography (SEC) or protein A column chromatography. The conjugate was characterized by UV-Vis, SEC and ESI-MS. The azido linkers attached to the antibody resulted in a 2777 Da or 2145 Da mass increase for the DAR4 conjugate with BL2 and BL12 respectively. Conjugates' monomer purity was >99% by SEC.

Example 21I: a Representative Procedure for Step 2: Making a Site-Specific Azido-Functionalized Antibody Drug Conjugate Containing 8 Azido Groups Using Branched (BL) Linkers Via [2+3] Click Reactions Between Azido-Functionalized Antibodies and an Alkyne Containing Linker-Payload (Table 23)

A site-specific antibody drug conjugate was prepared by incubating an azido-functionalized antibody (1-20 mg/mL) in PBS (pH7.4) with 10-20 molar equivalents of a linker-payload dissolved in an organic solvent such as DMSO or DMA (10 mg/mL) to have the reaction mixture containing 5-15% organic solvent (v/v), at 25-37° C. for 1-48 hours while gently shaking. The reaction was monitored by ESI-MS. Upon completion, the excess linker-payload and protein aggregates were removed by size exclusion chromatography (SEC). The purified conjugate was concentrated, sterile filtered and characterized by UV-Vis, SEC and ESI-MS. Conjugate's monomer purity was >99% by SEC.

Example 21J: Synthesis of Anti-HER2 ADCs

In a specific example, aglycosylated anti-Her2 human IgG antibody containing an N297Q mutation was mixed with 82 molar equivalents of a bis azido-alkyl substituted amine (BL2, MW 708.82 g/mL). The resulting solution was mixed with microbial transglutaminase (1 U mTG per mg of antibody, Millipore-Sigma) resulting in a final concentration of the antibody at 7.9 mg/mL. The reaction mixture was incubated at 37° C. for 30 hours while gently shaking while monitored by ESI-MS. Upon completion, the excess amine and mTG were removed by size exclusion chromatography (SEC). The conjugate was characterized by UV-Vis, SEC and ESI-MS. The azido linkers attached to the antibody resulted in a 2777 Da mass increase for the DAR4 conjugate.

The site-specific antibody azido conjugate (2.3 mg/mL) in PBS (pH7.4) was mixed with 13 molar equivalents of linker-payload (LP1) in 10 mg/mL of DMA to have the reaction mixture containing 12% organic solvent (v/v), and the solution was set at 26° C. for 27 hours while gently shaking. The reaction was monitored by ESI-MS. Upon completion, the excess linker-payload and protein aggregates were removed by size exclusion chromatography (SEC). The purified conjugate was concentrated, sterile filtered and characterized by UV-Vis, SEC and ESI-MS. Conjugates monomer purity was 99.9% by SEC. The drug attached to the antibody resulted in a 11175 Da mass increase for the DAR8 conjugate.

TABLE 23

List of mAb, Azido-Ab conjugate, and ADC

| | Antibody Description | Site of Conjugation | Modification: AL, BL, LP # | Modification: MW (g/mol) | DAR by ESI-MS | ESI-MS (m/z) |
|---|---|---|---|---|---|---|
| 1 | Anti-HER2 | Q295 | None | NA | NA | 145122 (degly) |
| 2 | Anti-HER2 | Q295 | $[AL1]_2$ | 218.3 | 2 | 145519 |
| 3 | Anti-HER2 | Q295 | $[AL1\text{-}LP1]_2$ | 1614.8 | 1.8 | 148330 |
| 4 | Isotype | Q295 | None | NA | NA | 145443 |
| 5 | Isotype | Q295 | $[AL1]_2$ | 218.3 | 2 | 145823 |
| 6 | Isotype | Q295 | $[AL1\text{-}LP1]_2$ | 1614.8 | 2 | 148619 |
| 7 | Anti-HER2 | Q295 | None | NA | NA | 145139 |
| 8 | Anti-HER2 | Q295, Q297 | $[AL1]_4$ | 218.3 | 4 | 145943 |
| 9 | Anti-HER2 | Q295, Q297 | $[BL7]_4$ | 325.4 | 4 | 146372 |
| 10 | Anti-HER2 | Q295, Q297 | $[AL1\text{-}LP1]_4$ | 1614.8 | 4 | 151544 |
| 11 | Anti-HER2 | Q295, Q297 | $[BL7\text{-}(LP1)_2]_4$ | 3118.4 | 8 | 157557 |
| 12 | Anti-STEAP2 | Q295, Q297 | None | NA | NA | 144006 |
| 13 | Anti-STEAP2 | Q295, Q297 | $[AL1]_4$ | 218.3 | 4 | 144787 |
| 14 | Anti-STEAP2 | Q295, Q297 | $[BL7]_4$ | 325.4 | 4 | 145208 |
| 15 | Anti-STEAP2 | Q295, Q297 | $[AL1\text{-}LP1]_4$ | 1614.8 | 4 | 150364 |
| 16 | Anti-STEAP2 | Q295, Q297 | $[BL7\text{-}(LP1)_2]_4$ | 3118.4 | 8 | 156381 |
| 17 | Isotype Control | Q295, Q297 | None | NA | NA | 145451 |
| 18 | Isotype Control | Q295, Q297 | $[AL1]_4$ | 218.3 | 4 | 146245 |
| 19 | Isotype Control | Q295, Q297 | $[BL7]_4$ | 325.4 | 4 | 146678 |
| 20 | Isotype Control | Q295, Q297 | $[AL1\text{-}LP1]_4$ | 1614.8 | 4 | 151849 |
| 21 | Isotype Control | Q295, Q297 | $[BL7\text{-}(LP1)_2]_4$ | 3118.4 | 8 | 157863 |
| 22 | Anti-HER2 | Q295, Q297 | $[BL2]_4$ | 708.8 | 3.8 | 147915 |
| 23 | Anti-HER2 | Q295, Q297 | $[BL2\text{-}(LP1)_2]_4$ | 3488.8 | 7.5 | 147918 |
| 24 | Anti-HER2 | Q295, Q297 | $[BL12]_4$ | 550.7 | 4 | 147282 |
| 25 | Anti-HER2 | Q295, Q297 | $[BL12\text{-}(LP1)_2]_4$ | 3329 | 8 | 158453 |
| 26 | Isotype Control | Q295, Q297 | $[BL2]_4$ | 708.8 | 3.8 | 148235 |
| 27 | Isotype Control | Q295, Q297 | $[BL2\text{-}(LP1)_2]_4$ | 3483.5 | 7.1 | 159398 |
| 28 | Isotype Control | Q295, Q297 | $[BL12]_4$ | 550.7 | 4 | 147593 |
| 29 | Isotype Control | Q295, Q297 | $[BL12\text{-}(LP1)_2]_4$ | 3324.5 | 8 | 158762 |

Example 22: Characterization of ADCs

Example 22A: SDS-PAGE for Analysis of ADC Integrity and Purity

In one method, SDS-PAGE running conditions include non-reduced and reduced samples (1-2 µg) along with Precision Plus Protein Dual Color Standards (Bio-rad, 500 µl, Cat #1610374) are loaded per lane in (1.0 mm×10 well)

Novex 4-20% No Tris-Glycine Gel and is run at 180V, 300 mA, for 80 minutes. A non-reduced sample is prepared using NuPAGE® LDS Sample Buffer (4×) (Thermo Fisher Scientific, Cat #1887691) and the reduced sample are prepared with SDS sample buffer (4×) containing 10% sample reducing agent (10×) (Thermo Fisher Scientific, Cat #1769410).

Molecular weights of the antibodies and ADCs on SDS-PAGE are determined under non-reducing and reducing conditions. The mass shifts may not be obvious under non-reducing conditions due to relatively small percentages of mass changes. However, the masses of the heavy chains are increased from the naked antibodies to the azido-functionalized antibodies, and further to the ADC conjugates.

Example 22B: Size Exclusion Chromatography (SEC) for ADC Analysis and Purification To determine the purity of antibody drug conjugates, size exclusion chromatography is performed. Analytical SEC experiments are run using a Thermo UltiMate™ 3000 instrument, on a XBridge Protein BEH SEC Column (Waters, 200A, 3.5 μm, 7.8 mm×300 mm), and each sample (30-40 μg, 20 μL) are run at flow rate of 0.5 mL/min using PBS pH 7.4 with 15% 2-propanol and monitored at λ280 nm using Thermo DAD-3000 RS Rapid Separation Diode Array Detector.

ADCs are purified by Size Exclusion Chromatography (SEC) and concentrated by using ultra centrifugation. To separate the antibody drug conjugates from the reaction mixture, preparative SEC purifications are performed using the ÄKTA instrument from GE Healthcare, on a Superdex® 200 increase 10/300 GL (1.0×30 cm) column, at the flow rate of 0.6 mL/min eluting with BupH at pH 7.4, and monitored at A280 nm. To concentrate the product Amicon® Ultra-4 Centrifugal Filters (Ultracel-10K) are used in Allegra x-12r centrifuge and the solution is stirred after each concentration to avoid high aggregation.

Example 22C: RP-HPLC for ADC Analysis

The intact mass for an ADC samples by RP-HPLC was performed to determine whether the LPs have been fully conjugated and also used to calculate the average DAR.

Each sample was treated with Dithiothreitol (DTT, 0.5M) and then incubated at 37° C. for 30 min prior to the RP-HPLC analysis. The RP-HPLC was performed using a Thermo UltiMate™ 3000 instrument, on a XBridge Protein BEH C4 column (300 Å, 2.5 μm, 4.6×100 mm; Cat No. 186009137), and the column oven was heated to 65° C. Each testing sample (10-20 μg, 10 μL) was loaded and run at the flow rate of 1 mL/min using different gradients of Mobile Phase A (100% ddH2O with 0.1% TFA) and Mobile Phase B (80% ACN, 20% IPA with 0.1% TFA) shown in Table 24 below and monitored at A280 nm using Thermo DAD-3000 RS Rapid Separation Diode Array Detector.

TABLE 24

RP-HPLC Gradients for ADC analysis

| Time (min) | Flow rate (ml/min) | A % | B % |
|---|---|---|---|
| 0.00 | 1.00 | 80 | 20 |
| 15.00 | 1.00 | 50 | 50 |
| 16.00 | 1.00 | 5 | 95 |
| 18.00 | 1.00 | 5 | 95 |

TABLE 24-continued

RP-HPLC Gradients for ADC analysis

| Time (min) | Flow rate (ml/min) | A % | B % |
|---|---|---|---|
| 18.10 | 1.00 | 80 | 20 |
| 24.00 | 1.00 | 80 | 20 |

Example 22D: LC-ESI-MS for Intact Mass Analysis of Antibody and ADC

Measurement of intact mass for the ADC samples by LC-ESI-MS was performed to determine payload distribution profile and to calculate the average DAR. Each testing sample (0.5-1 μg) was loaded onto Waters Protein BEH C4 Column (300 Å, 1.7 μm, 2.1 mm×50 mm; Cat No. 186004495) with different gradients of the Mobile Phase A (ddH2O with 0.1% FA) and Mobile Phase B (ACN with 0.1% FA) (as shown in Table 25 below), at the flow rate of 0.25 μL/min, and monitored at λ280 nm. Then the product was eluted, and the mass spectra was acquired by Thermo Q EXACTIVE HF-X.

TABLE 25

LC-ESI-MS gradients for intact mass analysis of Antibody and ADC

| No. | Time (min) | Flow (μL/min) | % B | Curve |
|---|---|---|---|---|
| 1 | 0.000 | | Equilibration | |
| 2 | 0.000 | 0.250 | 10.0 | 5 |
| 3 | New Row | | | |
| 4 | 0.000 | | Run | |
| 5 | 0.000 | 0.250 | 10.0 | 5 |
| 6 | 3.000 | 0.250 | 10.0 | 5 |
| 7 | 7.000 | 0.250 | 90.0 | 5 |
| 8 | 8.000 | 0.250 | 90.0 | 5 |
| 9 | 8.100 | 0.250 | 10.0 | 5 |
| 10 | 10.000 | 0.250 | 10.0 | 5 |
| 11 | New Row | | | |
| 12 | 10.000 | | Stop Run | |

Example 23: In Vitro Cytotoxicity Assay in Tumor Lines

To test the ability of anti-HER2 or anti-STEAP2 antibody drug conjugates (ADCs) of the present disclosure to kill human cell lines, an in vitro cytotoxicity assay was performed. In vitro cytotoxicity of the ADCs, isotype control ADCs, and reference free payloads were evaluated using the CellTiter-Glo 2.0 Assay Kit (Promega, Cat #g9243), in which the quantity of ATP present is used to determine the number of viable cells in culture.

For the assay, Calu-3, SK-BR-3, NCI-H1975, C42, or C42/STEAP2 KO (knockout) cells were seeded at 1000 cells/well in poly-D-lysine coated white 96 well Biocoat plates (Corning #356693) in complete growth medium and grown overnight at 37° C. in 5% $CO_2$. Three-fold serial dilutions of anti-HER2 ADCs or isotype control ADCs were prepared in dilution media (Optimem+0.1% BSA) and added to cells at final concentrations ranging from 100 nM to 0.015 nM (concentrations were corrected for the DAR (drug antibody ratio) and dosed based on the effective payload concentration). Three-fold serial dilutions of free payloads were prepared in 100% DMSO, transferred to fresh dilution media, and then added to the cells at a final constant DMSO concentration of 0.2% and final payload concentrations ranging from 100 nM to 0.015 nM. The last well in each dilution series (untreated wells) served as blank controls containing only the media (ADCs) or media plus 0.2% DMSO (payloads) and was plotted as a continuation of the 3-fold serial dilution. Six days later, 100 μL of CellTiter glo 2.0 was added to each well, plates were mixed for 2 minutes on an orbital shaker, and plates were incubated at room temperature for 10 minutes. Relative light units (RLUs) were measured on an Envision luminometer (PerkinElmer), and cell viability was expressed as a percentage of the untreated (100% viable) cells. $IC_{50}$ values were determined using a four-parameter logistic equation over a 10-point dose response curve (GraphPad Prism). The maximum % kill was also determined for each test article as follows: 100—minimum percent viability. Two independent experiments were run (Tables 26 and 27, respectively, shown below) and the $IC_{50}$ values and maximum % kill of each test article are reported.

As shown in Tables 26 and 27, anti-HER2 ADCs conjugated via glutamines killed high HER2 expressing SK-BR-3 cells with $IC_{50}$ values ranging from 68.5 pM to 86.1 pM and maximum % kill values ranging from 82.2% to 93.3%. An anti-HER2 ADC conjugated via cysteines killed SK-BR-3 cells with an $IC_{50}$ value of 147 pM and a maximum % kill value of 90.9%. In a second experiment, anti-HER2 ADCs conjugated via glutamines killed high HER2 expressing Calu-3 and SK-BR-3 cells with $IC_{50}$ values ranging from of 183 pM to 431 pM and maximum % kill values ranging from 89.6% to 95.3%. An anti-HER2 ADC conjugated via cysteines killed SK-BR-3 and Calu-3 cells with $IC_{50}$ values of 1.16 nM and 1.38 nM, respectively and maximum % kill values of 85.9% and 94.2%, respectively. All anti-HER2 ADCs were weakly cytotoxic in low HER expressing NCI-H1975 cells with $IC_{50}$ values >100 nM, and all non-binding control ADCs were weakly cytotoxic in all tested cells with $IC_{50}$ values ≥40.1 nM. The unconjugated anti-HER2 antibodies were also weakly cytotoxic in all tested lines with $IC_{50}$ values ≥12.8 nM and maximum percent values less than or equal to 48.5%. The free Dxd payload released from the ADCs killed cells with $IC_{50}$ values ranging from 787 pM to 11.8 nM and maximum % kill values ranging from 96.1% to 98.2%.

TABLE 26

Cytotoxicity of anti-HER2 ADCs in SK-BR-3 and NCI-H1975 cells

| | | | | | SK-BR-3 | | NCI-H1975 | |
|---|---|---|---|---|---|---|---|---|
| Test Article | Description | Target | Conj. Site | DAR | IC50 (M) | Max % Kill | IC50 (M) | Max % Kill |
| 11 | Anti HER2 Ab-$[(BL7)-(LP1)_2]_4$ | HER2 | Q295, Q297 | 8 | 8.61E-11 | 93.3 | >1.0E-07 | 7.0 |
| 10 | Anti HER2 Ab-$(AL1-LP1)_4$ | HER2 | Q295, Q297 | 4 | 6.85E-11 | 89.3 | >1.0E-07 | 10.8 |
| 3 | Anti HER2 Ab-$(AL1-LP1)_2$ | HER2 | Q295 | 1.8 | 7.06E-11 | 82.2 | >1.0E-07 | 2.9 |
| 22 (Comparison ADC) | Anti HER2 cys-GGFG-DxD | HER2 | Cys | 8.4 | 1.47E-10 | 90.9 | >1.0E-07 | 8.4 |
| 21 | Isotype Ab $[(BL7)-(LP1)_2]_4$ | Nontarget control | Q295, Q297 | 8 | >1.0E-07 | 10.5 | >1.0E-07 | 8.1 |
| 20 | Isotype Ab $(AL1-LP1)_4$ | Nontarget control | Q295, Q297 | 4 | 2.28E-08 | 83 | >1.0E-07 | 4.2 |
| 6 | Isotype Ab $(AL1-LP1)_2$ | Nontarget control | Q295 | 2 | >1.0E-07 | 0 | >1.0E-07 | 4.3 |
| 23 (Comparison ADC) | Isotype Ab cys-GGFG-DxD | Nontarget control | Cys | 6.9 | >1.0E-07 | 41.9 | >1.0E-07 | 2.8 |
| Dxd | Free payload | NA | NA | NA | 7.87E-10 | 97.1 | 8.91E-09 | 95.9 |

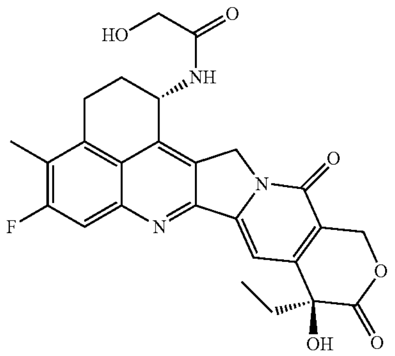

Dxd

TABLE 27

Cytotoxicity of anti-HER2 ADCs in SK-BR-3, Calu-3, and NCI-H1975 cells

| | | | | | SK-BR-3 | | Calu-3 | | NCI-H1975 | |
|---|---|---|---|---|---|---|---|---|---|---|
| Test Article | Description | Target | Conjugation site | DAR | IC50 (M) | Max % Kill | IC50 (M) | Max % Kill | IC50 (M) | Max % Kill |
| 11 | Anti HER2 Ab-[(BL7)-(LP1)$_2$]$_4$ | HER2 | Q295, Q297 | 8 | 1.86E−10 | 95.3 | 4.31E−10 | 94.2 | >1.0E−07 | 13.6 |
| 10 | Anti HER2 Ab-(AL1-LP1)$_4$ | HER2 | Q295, Q297 | 4 | 1.83E−10 | 89.7 | 4.14E−10 | 89.6 | >1.0E−07 | 15.5 |
| 22 (Comparison ADC) | Anti HER2 cys-GGFG-DxD | HER2 | Cys | 7.4 | 1.16E−09 | 85.9 | 1.38E−09 | 94.2 | >1.0E−07 | 20.4 |
| Dxd | Free payload | NA | NA | NA | 1.56E−09 | 98.2 | 2.14E−09 | 96.3 | 1.18E−08 | 96.1 |
| 7 | Anti HER2 Ab with N297Q Fc, unconjugated antibody | HER2 | NA | NA | 1.28E−08 | 48.5 | >1.0E−07 | 23.3 | >1.0E−07 | 21.1 |
| 21 | Isotype Ab [(BL7)-(LP1)$_2$]$_4$ | Nontarget control | Q295, Q297 | 8 | >1.0E−07 | 21.7 | >1.0E−07 | 0.6 | >1.0E−07 | 6.4 |
| 1 | Anti HER2 Ab, Unconjugated antibody | HER2 | NA | NA | 2.64E−08 | 43.0 | >1.0E−07 | 24.3 | >1.0E−07 | 15.7 |
| 20 | Isotype Ab (AL1-LP1)$_4$ | Nontarget control | Q295, Q297 | 4 | 4.01E−08 | 78.9 | 7.96E−08 | 53.9 | >1.0E−07 | 12.5 |

TABLE 28

Cytotoxicity of anti-STEAP2 ADCs in C4-2 and C4-2/STEAP2 KO cells

| | | | | | C4-2 | | C4-2/STEAP2 KO | |
|---|---|---|---|---|---|---|---|---|
| Test Article | Description | Target | Conjugation site | DAR | IC50 (M) | Max % Kill | IC50 (M) | Max % Kill |
| 15 | Anti STEAP2 Ab-(AL1-LP1)$_4$ | STEAP2 | Q295, Q297 | 4 | 3.15E−08 | 54.8 | >1.0E−07 | 4.2 |
| 16 | Anti STEAP2 Ab-[(BL7)-(LP1)$_2$]$_4$ | STEAP2 | Q295, Q297 | 8 | 3.22E−08 | 58.4 | >1.0E−07 | 0.0 |
| Dxd | (Free payload) | NA | NA | NA | 2.54E−09 | 81.7 | 3.43E−09 | 88.9 |
| 21 | Isotype Ab [(BL7)-(LP1)$_2$]$_4$ | Nontarget control | Q295, Q297 | 8 | >1.0E−07 | 7.8 | >1.0E−07 | 5.8 |
| 12 | Anti STEAP2 mAb, unconjugated antibody | STEAP2 | NA | NA | >1.0E−07 | 10.6 | >1.0E−07 | 9.4 |

As shown in Table 28, anti-STEAP2 ADCs conjugated via N297Q killed 4-2 cells with $IC_{50}$ values of 31.5 nM and 32.2 nM and maximum % kill values of 54.8% and 58.4%; whereas these same ADCs were weakly cytotoxic in C4-2/STEAP2 KO cells with $IC_{50}$ values >100 nM. The non-binding control ADCs and unconjugated anti-STEAP2 antibodies were also weakly cytotoxic in both tested cells lines with $IC_{50}$ values >100 nM. The free Dxd payload released from the ADCs killed both $C_4$-2 and $C_4$-2/STEAP2 KO cells with $IC_{50}$ values of 2.54 nM and 3.43 nM, respectively, and maximum % kill values of 81.7% and 98.9%, respectively.

Example 24: SKBR3 Cell-Based Assay

Anti-proliferation assays were performed using a SK-BR-3 human breast adenocarcinoma (pleural effusion) cell line. The cells were grown in McCoy's 5a Medium supplemented with 10% FBS, penicillin/streptomycin and L-glutamine. Cells were seeded 1000/well in 96-well plate in 80 ul complete growth media one day prior to adding ADCs and incubated at 37° C. 5% CO2 overnight. The ADCs were 1:3 serially diluted 10 points in assay media (Opti-MEM+0.1% BSA). The concentrations of the testing ADCs cover the range of 1 nM to ~1000 nM and also starting from different concentrations based on the cell killing potency in order to see EC50 covers, leaving the last well ($10^{th}$) as blank (no ADC or compound). Compounds were first 1:3 serially diluted 10 points in DMSO starting from 50 uM (the starting concentration of each compounds are different according to the EC50s), leaving the last well as blank (contains only DMSO). 10 ul DMSO-diluted compound was transferred to 990 ul assay media (Opti-MEM+0.1% BSA) in a 96-well deep well dilution plate. 20 ul assay media-diluted ADC and compound were added to cells. Cells were incubated at 37° C. 5% $CO_2$ for 6 days (144 hrs). Plates were developed by adding 100 ul CTG reagent/well to the cells CellTiter-Glo®, from Promega, Cat. No G7573), shaken at room temperature for 10 min, sealed with white adhesive bottom seal and luminescence was read with Envision. kill %=[1−($T144_{sample}$−$T144_{blank}$)/($T144_{DMSO}$−$T144_{blank}$)]×100%. Here, T144 is the data from time at 144 hours. The solution of payload compounds are prepared following: Compounds were first 1:3 serially diluted 10 points in DMSO starting from the working concentration (the starting concentration of each compounds are different according to the EC50s), leaving the last well as blank (contains only DMSO). 10 ul DMSO-diluted compound was transferred to 990 ul assay media (Opti-MEM+0.1% BSA) in a 96-well deep well dilution plate. 20 ul assay media-diluted ADO and compound is added to cells.

The EC50 values for the ADCs and control ADCs, as well the free payload (DXD and P3) were summarized in Table 21 and Table 23.

Example 25: In Vivo FGFR2 ADO Efficacy Study

This experiment measured the effect of FGFR2b Antibody-Drug Conjugates (ADCs) according to the disclosure on the growth of SNU-16 gastric cancer xenographs.

TABLE 29
FGFR2 ADCs:
| ADC Description | Target/mAb | Fc modification | Site of Conjugation | Azido Linker | Linker Payload | Payload | Structure of Modification | DAR | Dose |
|---|---|---|---|---|---|---|---|---|---|
| Control Dxd ADC | Non-targeting control | N297Q | Q295, Q297 | BL7 | LP1 | P2 (Dxd) | 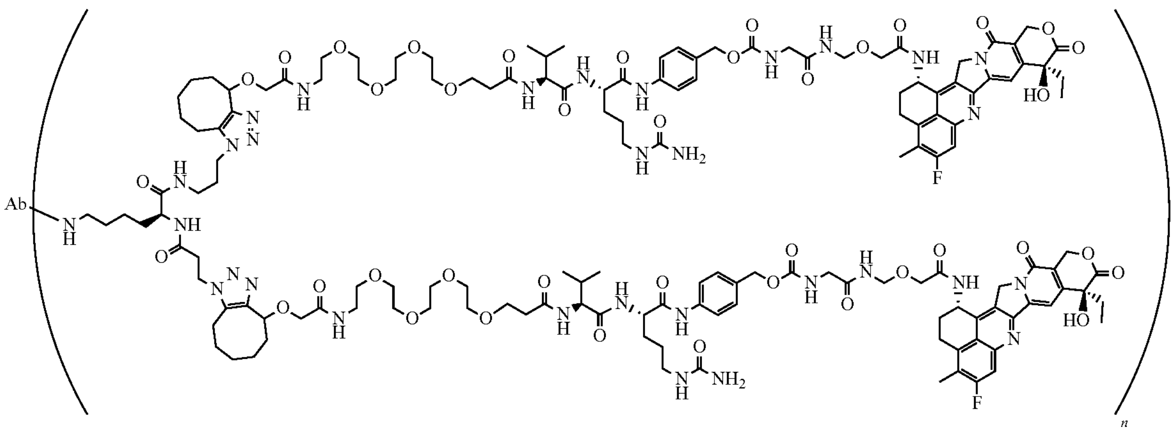 | 7.9 | 10 mg/kg |
| FGFR2 b-2 Dxd ADC | FGFR2b | N297Q | Q295, Q297 | BL7 | LP1 | P2 (Dxd) | 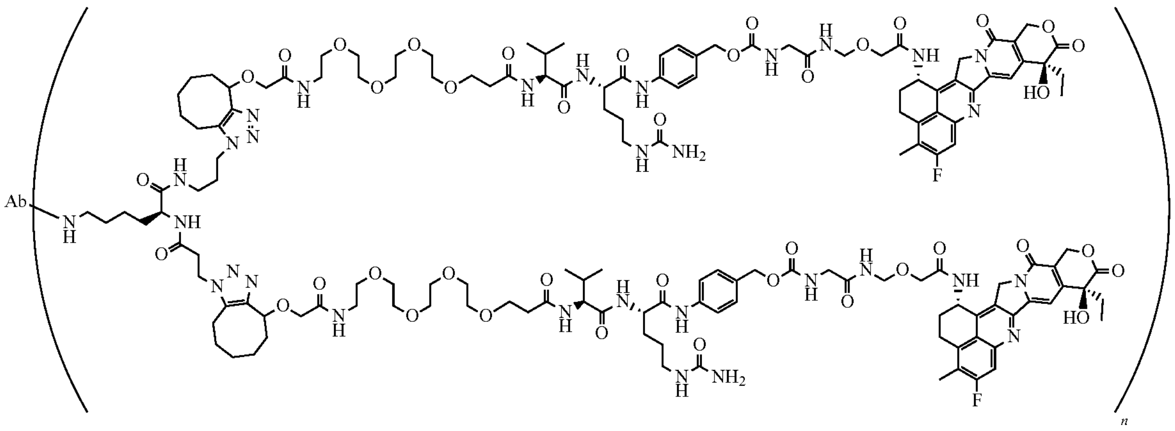 | 7.5 | 1, 3 or 10 mg/kg |

TABLE 29-continued
FGFR2 ADCs:
| ADC Description | Target/ mAb | Fc modification | Site of Conjugation | Azido Linker | Linker Payload | Payload | Structure of Modification | DAR | Dose |
|---|---|---|---|---|---|---|---|---|---|
| FGFR2 b-1 Dxd ADC | FGFR2b | N297Q | Q295, Q297 | BL7 | LP1 | P2 (Dxd) | 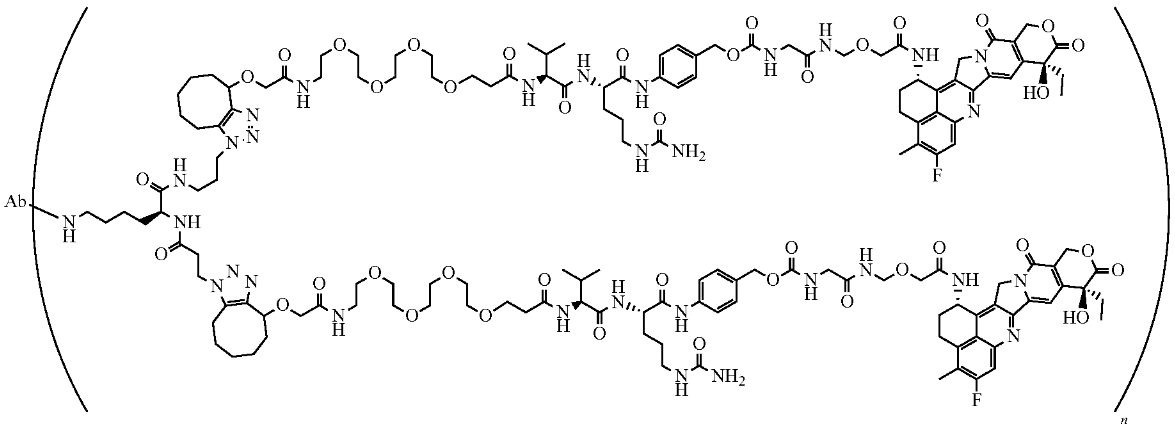 | 7.9 | 1, 3 or 10 mg/ kg |
| Control Dxd ADC | Non-targeting control | N297Q | Q295, Q297 | AL1 | LP1 | P2 (Dxd) | 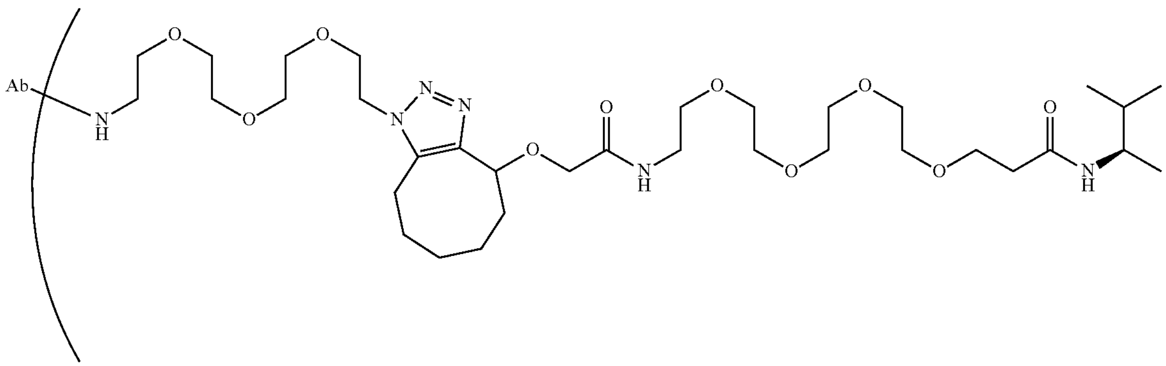 | 3.7 | 3 mg/ kg |

TABLE 29-continued
FGFR2 ADCs:
| ADC Description | Target/ mAb | Fc modification | Site of Conjugation | Azido Linker | Linker Payload | Payload | Structure of Modification | DAR | Dose |
|---|---|---|---|---|---|---|---|---|---|
| FGFR2 b-1 Dxd ADC | FGFR2b | N297Q | Q295, Q297 | AL1 | LP1 | P2 (Dxd) | 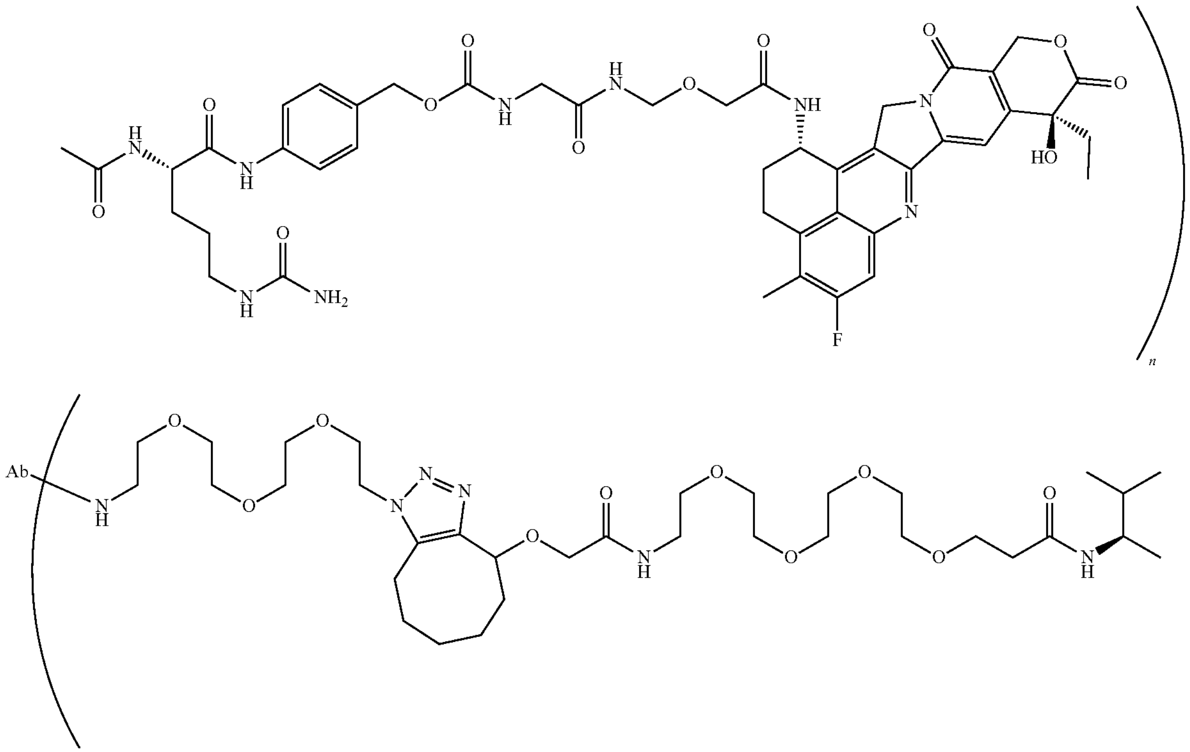 | 3.7 | 0.3, 1 or 3 mg/kg |

TABLE 29-continued
| FGFR2 ADCs: | | | | | | | | | |
|---|---|---|---|---|---|---|---|---|---|
| ADC Description | Target/ mAb | Fc modification | Site of Conjugation | Azido Linker | Linker Payload | Payload | Structure of Modification | DAR | Dose |
| | | | | | | | 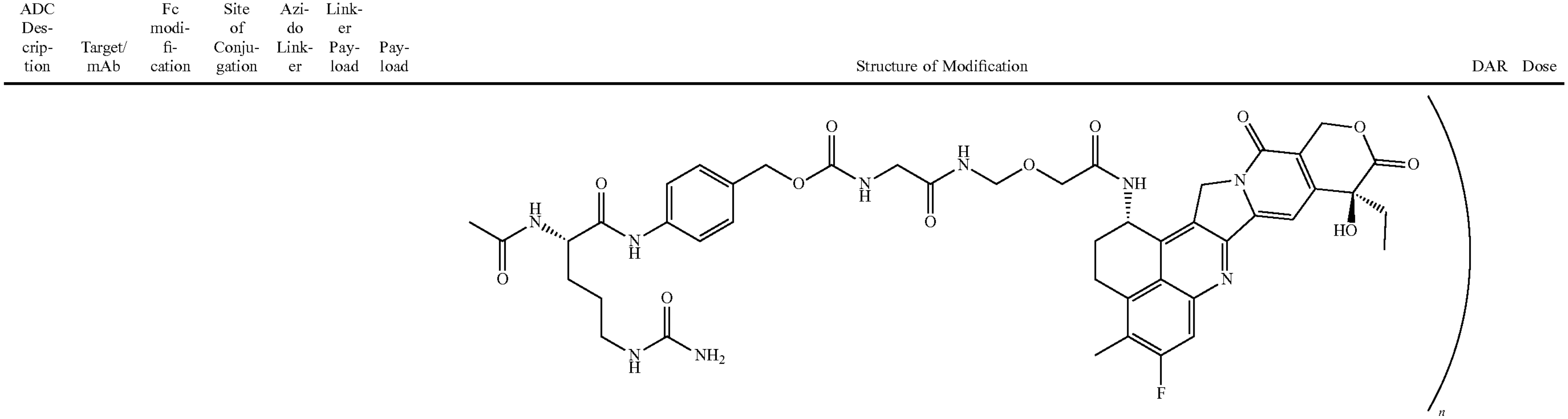 | | |

Experimental Procedure

To assess the anti-tumor activity of FGFR2b Dxd ADCs against SNU16 xenografts (human gastric cancer xenografts), $5\times10^6$ SNU-16 cells (ATOC) mixed with Matrigel (ED Biosciences) were implanted subcutaneously into the flank of male BALE/c SCID mice (6-8 weeks old, Jackson Laboratory). After tumors reached an average volume of 200-250 $mm^3$, mice were randomized into groups for treatment (n=6 mice per group). All ADCs were administered via subcutaneous injection. Tumor volumes were measured twice per week over the course of the experiment. Averages (mean+/−standard deviation) of the tumor growth (change in tumor volume from the start of treatment through the end of the experiment) were calculated for each treatment group. The percent decrease of tumor growth was calculated from comparison to the isotype control group, and the percent regression of tumors at the end of the experiment was calculated from comparison to the tumor volume at the start of treatment. The results from two separate experiments utilizing ADCs with different DARs are shown in Table 30.

TABLE 30

Inhibition of SNU-16 xenograft growth in BALB/c SCID mice

| Antibody (mg/kg) | Total Payload Dose (ug/kg) | Tumor growth in mm3 from start of treatment (mean ± SD) | Average % Decrease in Tumor Growth | Average % Tumor Regression |
|---|---|---|---|---|
| Experiment 1 (DAR 8 ADCs) | | | | |
| FGFR2b-2 Dxd ADC (1 mg/kg) | 25 | −27.2 ± 89.2 | 103.3 | 11.0 |
| FGFR2b-2 Dxd ADC (3 mg/kg) | 76 | −254.4 ± 34.1 | 131.4 | 99.1 |
| FGFR2b-2 Dxd ADC (10 mg/kg) | 254 | −259.0 ± 25.8 | 131.9 | 100 |
| FGFR2b-1 Dxd ADC (1 mg/kg) | 26 | 4.7 ± 181.9 | 99.4 | 6.7 |
| FGFR2b-1 Dxd ADC (3 mg/kg) | 79 | −259.8 ± 40.1 | 132.0 | 99.8 |
| FGFR2b-1 Dxd ADC (10 mg/kg) | 264 | −260.8 ± 25.0 | 132.1 | 100 |
| Control Dxd ADC (10 mg/kg) | 264 | 579.5 ± 229.3 | 28.6 | −192.9 |
| Vehicle control | | 811.5 ± 556.1 | | −291.8 |
| Experiment 2 (DAR 4 ADCs) | | | | |
| FGFR2b-1 Dxd ADC (0.3 mg/kg) | 4 | 187.0 ± 117.1 | 72.5 | −74.8 |
| FGFR2b-1 Dxd ADC (1 mg/kg) | 13 | −43.5 ± 91.6 | 106.4 | 16.3 |
| FGFR2b-1 Dxd ADC (3 mg/kg) | 38 | −254.2 ± 30.2 | 137.4 | 99.7 |
| Control Dxd ADC (3 mg/kg) | 38 | 679.0 ± 253.1 | | −259.1 |

Figure 8A:
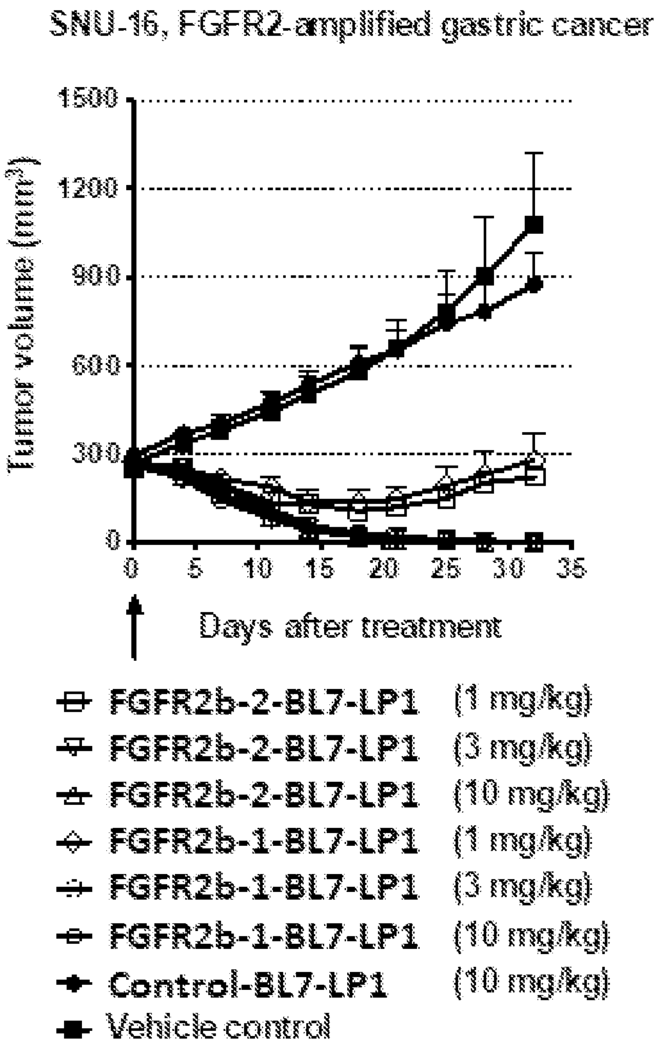
FIG. 8A (SNU16, FGFR2-amplified gastric cancer) and FIG. 8B (SNU16 tumor bearing mice) show tumor volume vs. days after treatment for anti-FGFR2b Dxd ADCs (DAR8) according to the disclosure. These ADCs demonstrated significant anti-tumor efficacy against SNU-16 human gastric cancer xenografts.
Figure 8B:
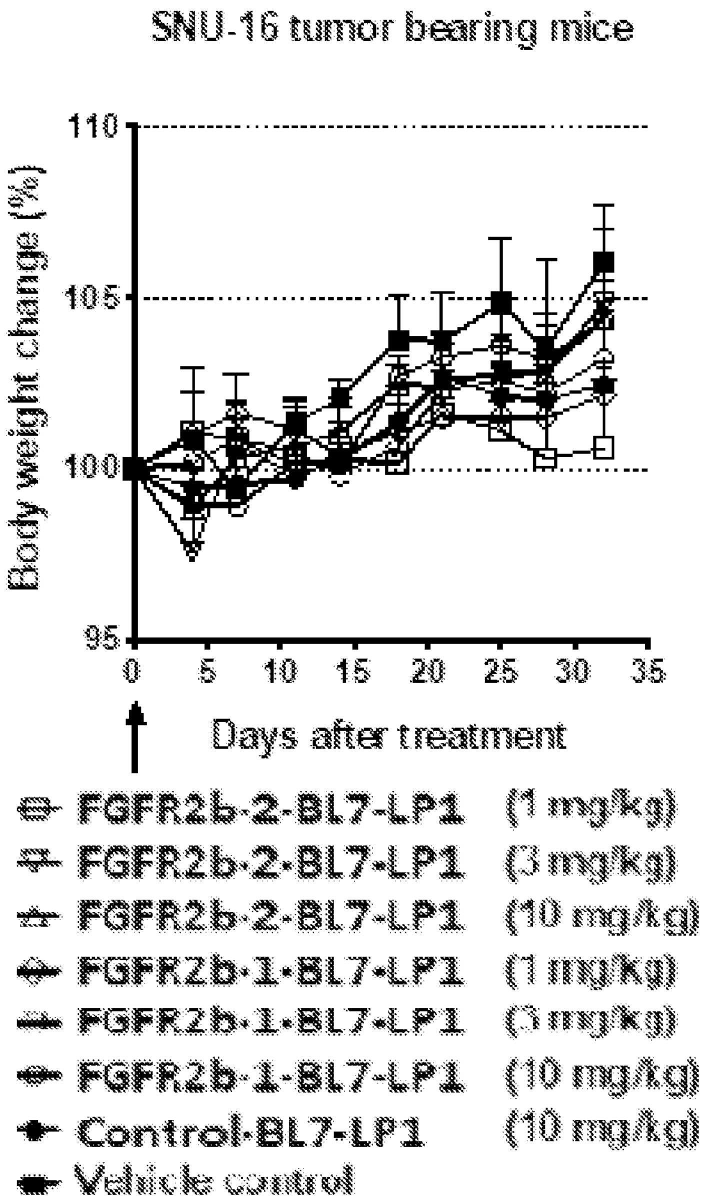
Figure 9A:
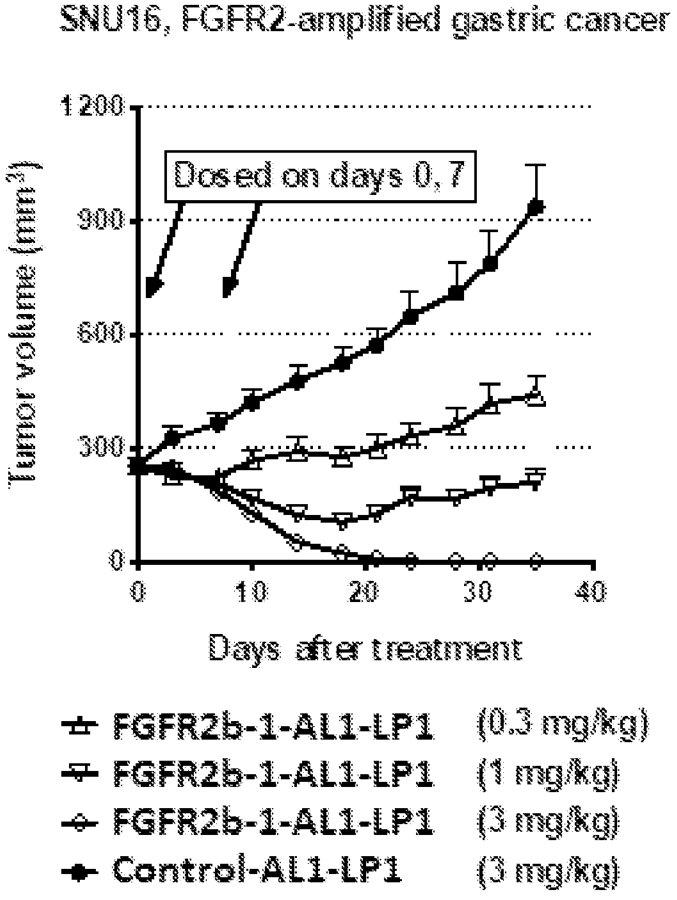
FIG. 9A (SNU16, FGFR2-amplified gastric cancer) and FIG. 9B (SNU16 tumor bearing mice) show tumor volume vs. days after treatment for anti-FGFR2b Dxd ADCs (DAR4) according to the disclosure. These ADCs demonstrated significant anti-tumor efficacy against SNU-16 human gastric cancer xenografts.
Figure 9B:
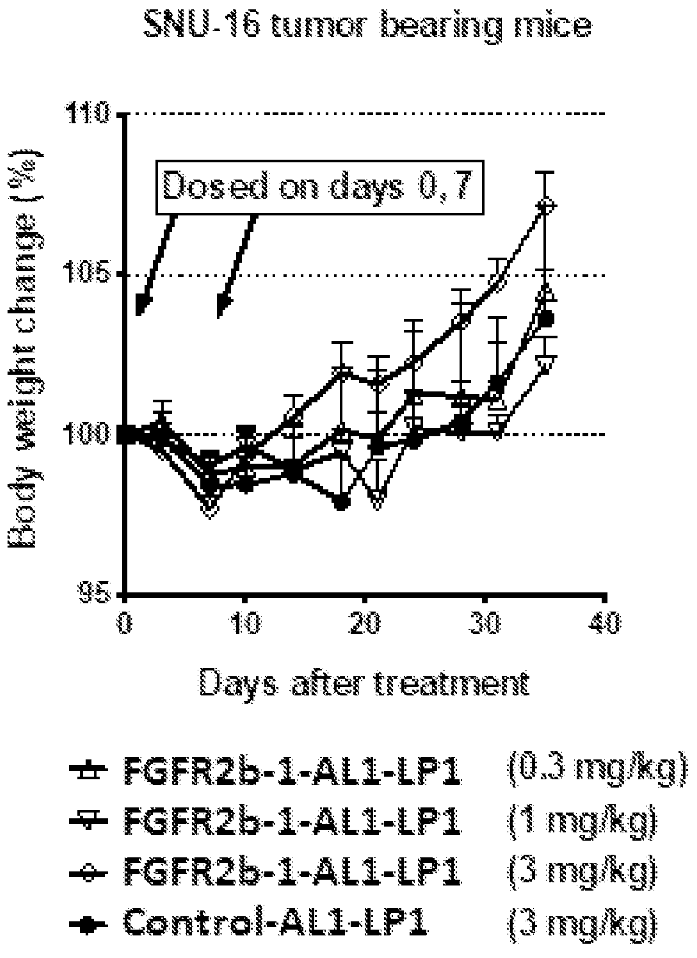

As shown in Table 30 and FIGS. 8A and 8B, the results demonstrate that FGFR2b Dxd ADCs induce complete regression of SNU-16 tumor xenografts in a dose dependent manner.

Example 26: In Vivo HER2 ADO Efficacy Study

This experiment compared the Trastuzumab-GGFG-DxD (comparator anti-HER2 ADO control) and Trastuzumab-vcPAB-G-DxD (anti-HER2 ADO according to the invention) in N87 xenografts.

TABLE 30

| HER2 ADCs | | | | | | | | | |
|---|---|---|---|---|---|---|---|---|---|
| Description | Target/ mAb | Fc modification | Site of Conjugation | Azido Linker | Linker Payload | Structure of Modification | Payload | DAR | Dose |
| Control | Non-targeting control | WT | | | | | | | 5 mg/kg Q1Wx1 |
| COMP mAb | HER2 (Trastuzumab) | WT | | | | | | | 5 mg/kg Q1Wx1 |
| Control-Dxd ADC | Non-targeting control | WT | Cysteine | NA | COMP LP mc-GGFG-Dxd | 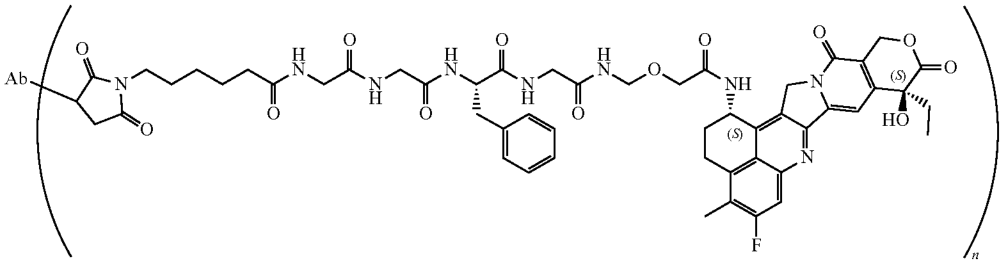 | P2 (Dxd) | 7.5 | 5 mg/kg Q1Wx1 |
| COMP-Dxd-ADC Control | HER2 (Trastuzumab) | WT | Cysteine | NA | COMP LP mc-GGFG-Dxd | 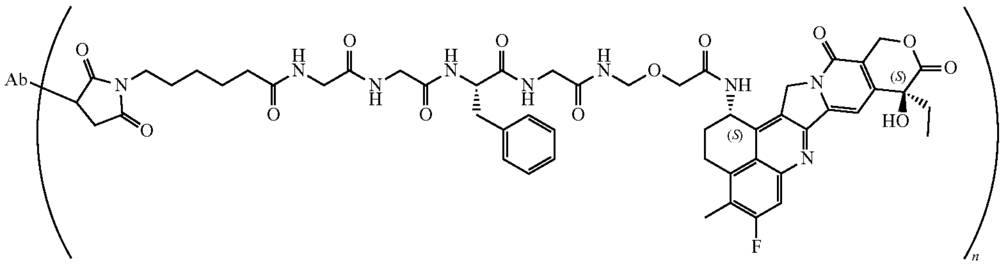 | P2 (Dxd) | 8 | 5 mg/kg Q1Wx1 |

TABLE 30-continued
| HER2 ADCs | | | | | | | | | |
|---|---|---|---|---|---|---|---|---|---|
| Description | Target/mAb | Fc modification | Site of Conjugation | Azido Linker | Linker Payload | Structure of Modification | Payload | DAR | Dose |
| Control-Dxd-ADC | Non-targeting control N297Q | N297Q | Q295 and Q297 | BL7 (branched) | LP1 (vcPAB-G-Dxd) | 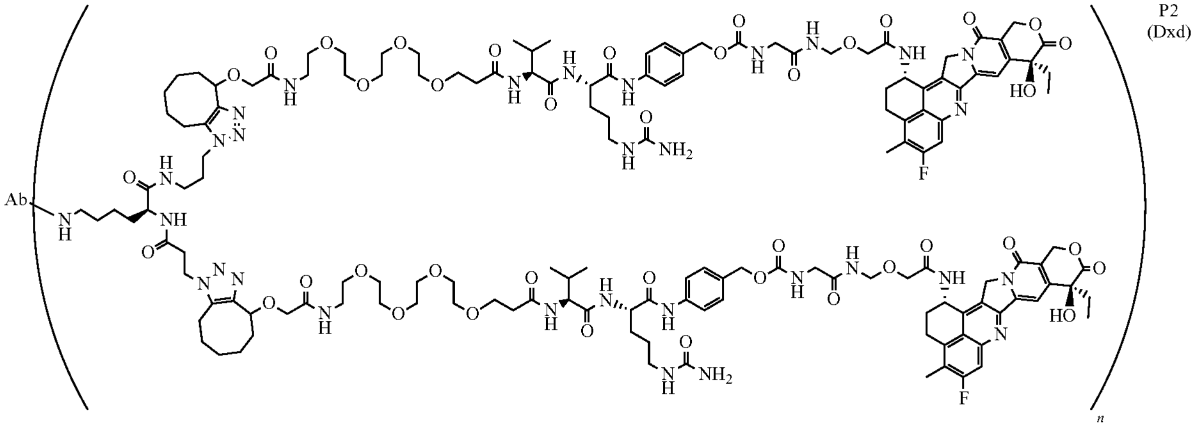 | P2 (Dxd) | 7.8 | 5 mg/kg Q1Wx1 |
| COMP-Dxd-ADC | HER2 (Trastuzumab) | N297Q | Q295 and Q297 | BL7 (branched) | LP1 (vcPAB-G-Dxd) | 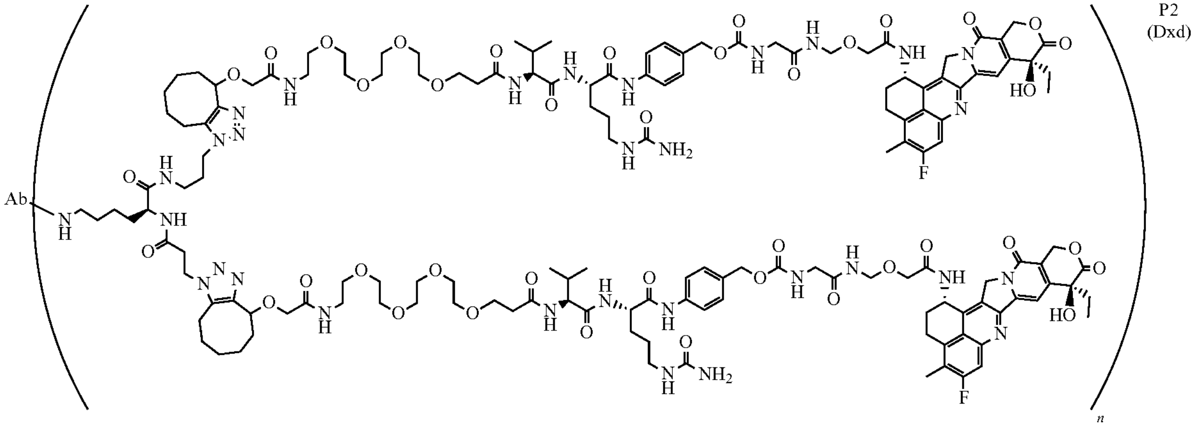 | P2 (Dxd) | 7.7 | 5 mg/kg Q1Wx1 |

Experimental Procedure:

The anti-tumor efficacy of Trastuzumab Comparator antibody was assessed in HER2 IHC 3+ N87 cell line xenograft models. Tumors were established by the subcutaneous implantation of $5\times10^6$ cells mixed 1:1 with Matrigel on the right flank of female SCID mice. Tumors were grown to ~250 $mm^3$ before treatment initiation, approximately 7 days post-implantation. Mice were randomized into groups of 6 and treated with a single dose of test or control ADCs. Tumor growth was monitored for 70 days post-treatment.

Experimental Results:

This study, performed in in HER2 IHO 3+N87 cell line xenograft bearing SCID mice assessed the activity of Trastuzumab Comparator antibody conjugated to either a DxD comparator LP or LP1 according to the disclosure conjugated through trans-glutaminase chemistry and a branched azido linker BL7. A single dose of 5 mg/kg was designed to minimize the effect of naked Trastuzumab in N87 xenografts, which are addicted to HER2 signaling. The growth of xenografts treated with Control-comparator-Dxd LP or Control-LP1 ADCs was not significantly delayed relative to naked Control ab treated tumors. However, a complete tumor regression was observed in tumors treated with Trastuzumab-comparator-Dxd LP and Trastuzumab-LP1 according to the disclosure at the 5 mg/kg ADO dose over the course of the study. The effect of the two test ADCs was indistinguishable in this study.

TABLE 31

Trastuzumab-GGFG-Dxd and Trastuzumab-TG-LP1 mediated tumor regression of N87 xenografts.

| Days post | Naked Control | | HER2 mAb | | Control-Dxd | | HER2-Dxd | | Control-LP1 | | HER2-LP1 | |
|---|---|---|---|---|---|---|---|---|---|---|---|---|
| implant | Average | StErr | Average | StErr | Average | StErr | Average | StErr | Average | StErr | Average | StErr |
| 7 | 160 | 13 | 159 | 8 | 161 | 6 | 159 | 10 | 146 | 13 | 154 | 10 |
| 10 (Dosing) | 245 | 18 | 243 | 16 | 247 | 15 | 247 | 15 | 247 | 15 | 247 | 15 |
| 13 | 424 | 36 | 366 | 20 | 399 | 48 | 273 | 19 | 432 | 50 | 307 | 40 |
| 15 | 530 | 55 | 410 | 29 | 534 | 59 | 158 | 23 | 497 | 43 | 143 | 18 |
| 17 | 686 | 84 | 506 | 35 | 587 | 67 | 75 | 6 | 670 | 89 | 82 | 12 |
| 20 | 870 | 106 | 602 | 34 | 838 | 74 | 44 | 8 | 776 | 81 | 40 | 3 |
| 22 | 1030 | 102 | 735 | 53 | 963 | 117 | 35 | 9 | 926 | 83 | 29 | 5 |
| 24 | 1226 | 200 | 788 | 60 | 1109 | 88 | 31 | 7 | 1023 | 76 | 26 | 4 |
| 27 | 1439 | 237 | 957 | 94 | 1269 | 129 | 11 | 2 | 1242 | 141 | 15 | 4 |
| 30 | 1678 | 247 | 1190 | 103 | 1507 | 180 | 10 | 2 | 1507 | 190 | 14 | 4 |
| 33 | | | 1310 | 36 | | | 11 | 2 | | | 14 | 2 |
| 37 | | | 1579 | 61 | | | 8 | 2 | | | 10 | 2 |
| 41 | | | 1998 | 198 | | | 8 | 2 | | | 15 | 2 |
| 44 | | | | | | | 5 | 1 | | | 12 | 5 |
| 50 | | | | | | | 5 | 0 | | | 12 | 6 |
| 58 | | | | | | | 7 | 2 | | | 12 | 6 |
| 65 | | | | | | | 7 | 2 | | | 12 | 6 |

This study demonstrates that the LP1 Dxd linker payload according to the disclosure conjugated to Trastuzumab antibody is at least as efficacious as the leading DxD comparator linker payload conjugated to the same antibody.

Example 27: In Vivo STEAP2 ADO Efficacy Study

This experiment assessed STEAP2 ADO efficacy in the STEAP2 cell line xenograft model.

TABLE 32
| STEAP2 ADCs | | | | | | | | | |
|---|---|---|---|---|---|---|---|---|---|
| Description | Target/ mAb | Fc modification | Site of Conjugation | Azido Linker | Linker Payload | Payload | Structure of Modification | DAR | Dose |
| Control | Non-targeting control | N297Q | Q295, Q297 | BL7 | LP1 (vcPA B-G-Dxd) | P2 (Dxd) | 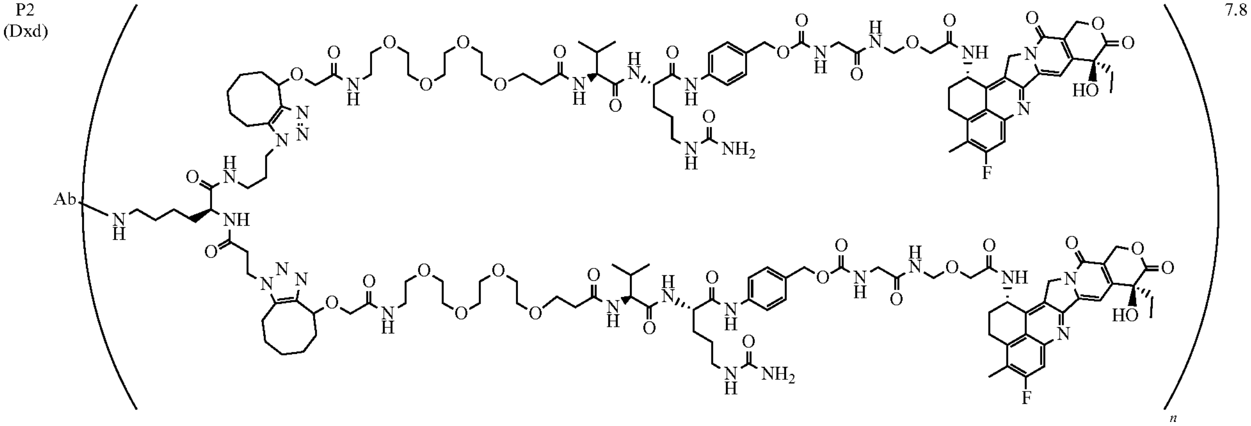 | 7.8 | 10 mg/kg |
| STEA P2 Dxd ADC | STEA P2 | N297Q | Q295, Q297 | BL7 | LP1 (vcPA B-G-Dxd) | P2 (Dxd) | 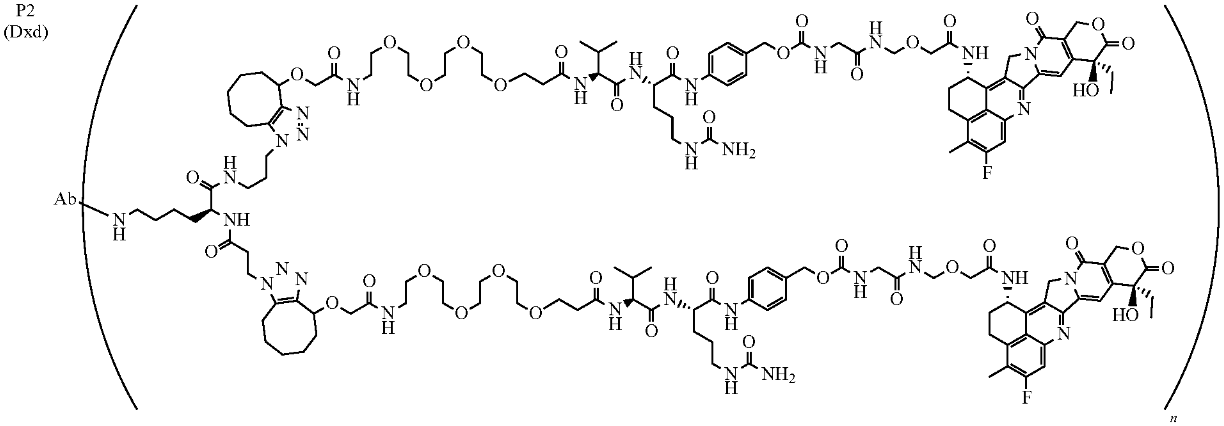 | 8.0 | 3 or 10 mg/kg |

Experimental Procedure:

To assess the activity of STEAP2 Dxd ADCs against 04-2 xenografts, tumors were established by the subcutaneous implantation of $7.5\times10^6$ C4-2 cells mixed 1:1 with Matrigel on the right flank of male SCID mice. Tumors were grown to around 200 $mm^3$ before treatment initiation, 15 days post-implantation. Mice were randomized into groups of 8 based on tumor volume and treated with a single dose of test or control ADO. Tumor growth was monitored for 50 days post-treatment.

Experimental Results:

The in vivo efficacy of STEAP2 Dxd ADCs were assessed relative to control agents (Table 33). Control Dxd ADC partially delayed tumor growth relative to vehicle treated tumors. Single dose 3 mg/kg STEAP2 Dxd ADC caused durable inhibition of tumor growth. STEAP2 Dxd ADC at 10 mg/kg caused complete tumor regression and no tumor re-growth was observed for the duration of the study. C4-2 tumors cause weight loss in mice as tumors grow. STEAP2 Dxd ADC at 3 or 10 mg/kg cause partial and complete rescue of weight loss respectively over the course of the study.

TABLE 33

Anti-STEAP2 ADCs mediated regression of C4-2 xenografts relative to controls (Day 30 post-treatment).

| Article | ADC Dose | Tumor volume ($mm^3$) at termination of vehicle group (mean ± SD) | Tumor growth ($mm^3$) from start of treatment (mean ± SD) |
|---|---|---|---|
| Vehicle | n/a | 1343 ± 362 | 1127 ± 363 |
| Control Dxd ADC | 10 mg/kg | 611 ± 436 | 392 ± 433 |
| STEAP2 Dxd ADC | 3 mg/kg | 131 ± 106 | −83 ± 110 |
| STEAP2 Dxd ADC | 10 mg/kg | 0 ± 0 | −203 ± 26 |

As shown above, anti-STEAP2 ADCs according to the disclosure demonstrated significant anti-tumor efficacy against STEAP2 positive C4-2 cell line xenografts.

Example 28: In Vivo PRLR ADC Efficacy Study

This experiment assessed anti-PRLR ADC efficacy in the T47D cell line xenograft model. The structure of the payload DM1 is provided below:

(DM1)

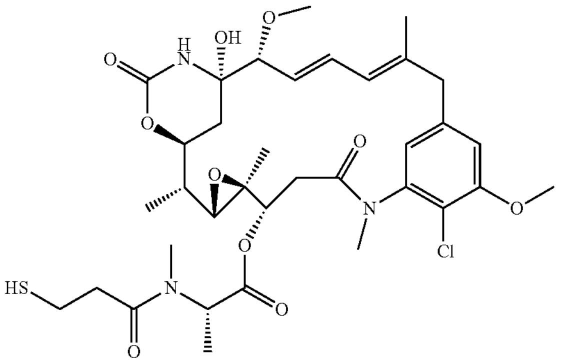

The linker-payload M1 (mcc-DM1) was prepared according to WO2015/031396 (PCT/US14/52757), which is incorporated by reference herein in its entirety. The linker-payload M1 was conjugated to a lysine residue of either a nontargeting control antibody or the anti-PRLR antibody as described in WO2015/031396.

TABLE 34
PRLR ADCs
| Description | Target/mAb | Fc modification | Site of Conjugation | Azido Linker | Linker Payload | Payload | Structure of Modification | Dose |
|---|---|---|---|---|---|---|---|---|
| Control DM1 ADCI | Non-targeting control | WT | Lys | NA | M1 (mcc-DM1) | DM1 | 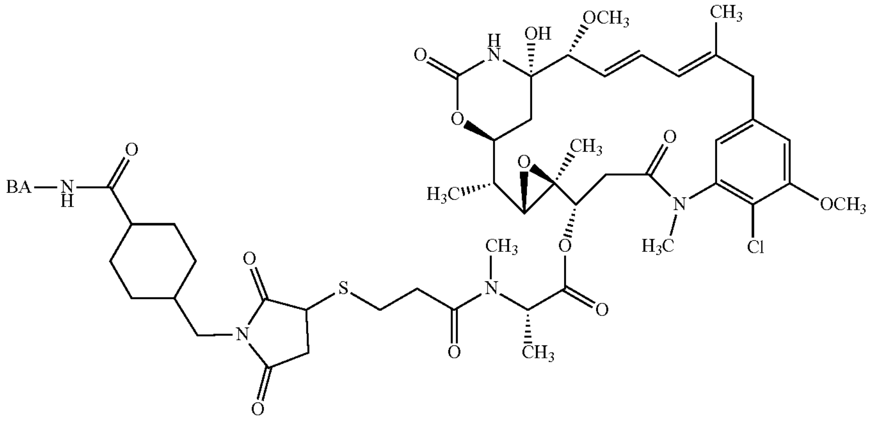 | 10 mg/kg SD |
| PRLR DM1 ADC | PRLR | WT | Lys | NA | M1 (mcc-DM)1 | DM1 | 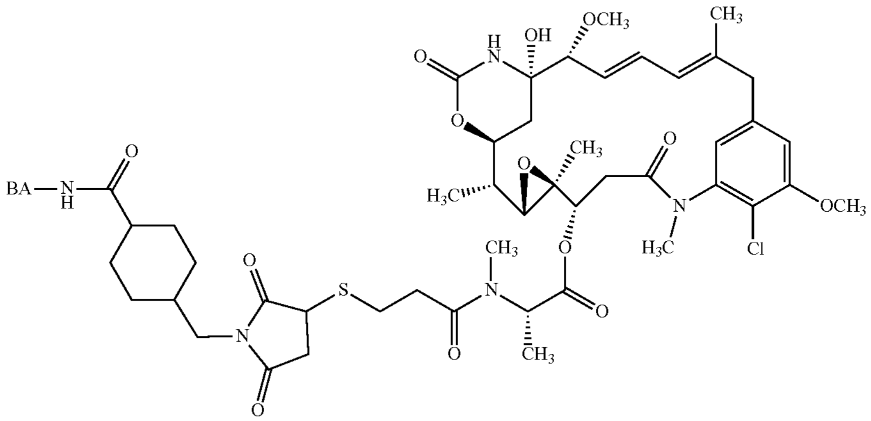 | 10 mg/kg SD |

TABLE 34-continued
| PRLR ADCs | | | | | | | | |
|---|---|---|---|---|---|---|---|---|
| Description | Target/mAb | Fc modification | Site of Conjugation | Azido Linker | Linker Payload | Payload | Structure of Modification | Dose |
| Control Dxd ADC | Non-targeting control | N297Q | Q295 and Q297 | AL1 | LP1 (vcPAB-G-Dxd) | P2 (Dxd) | 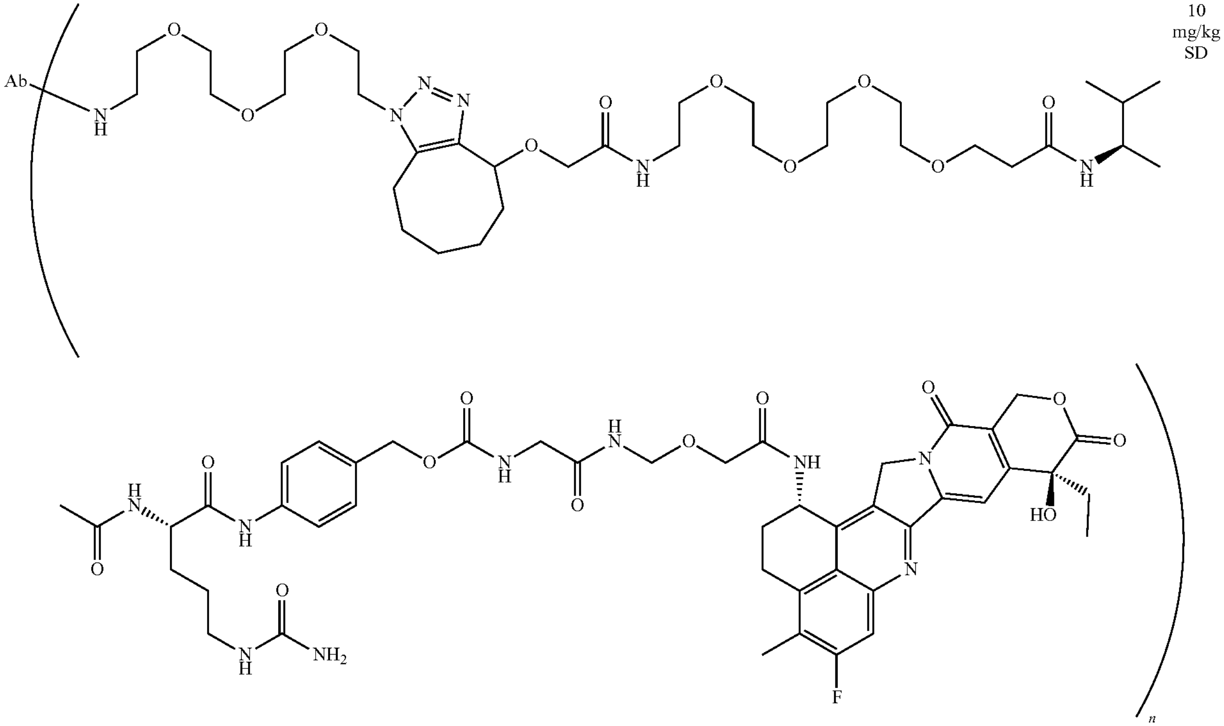 | 10 mg/kg SD |

TABLE 34-continued
| PRLR ADCs | | | | | | | | |
|---|---|---|---|---|---|---|---|---|
| Description | Target/mAb | Fc modification | Site of Conjugation | Azido Linker | Linker Payload | Payload | Structure of Modification | Dose |
| PRLR Dxd ADC | PRLR | N297Q | Q295 and Q297 | AL1 | LP1 (vcPAB-G-Dxd) | P2 (Dxd) | 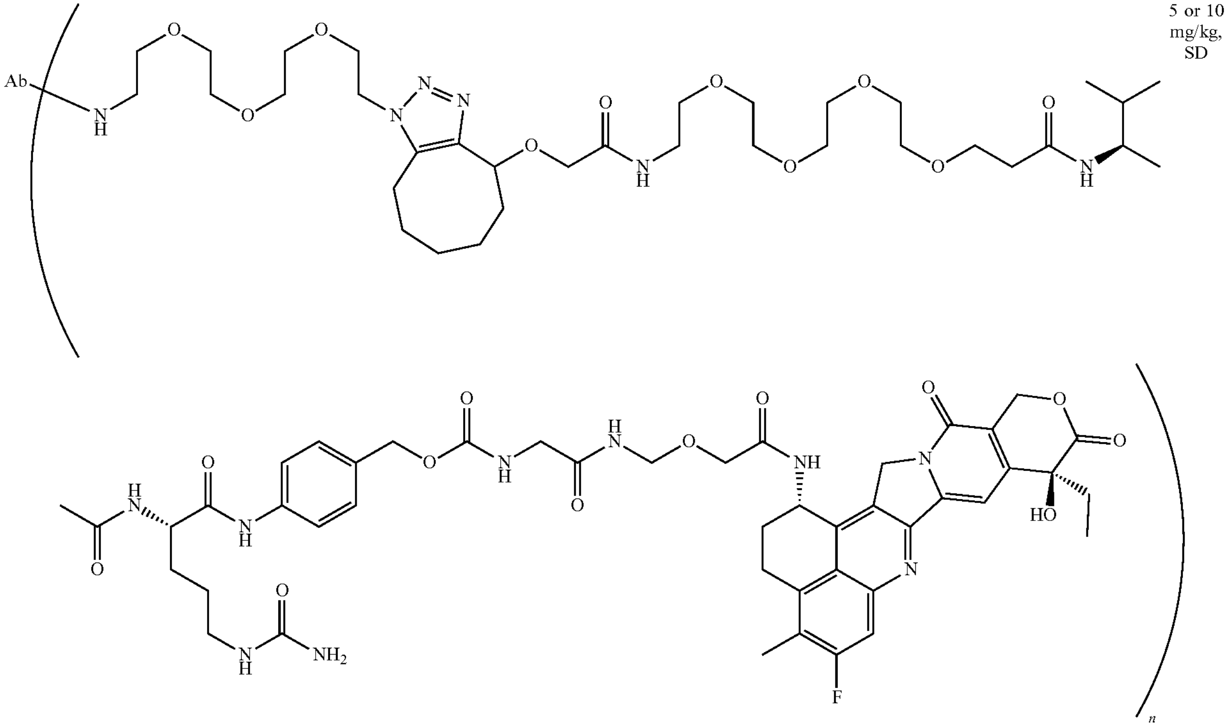 | 5 or 10 mg/kg, SD |
SD = single dose Experimental Procedure:

Tumorigenic T47D cells named T47DvII were previously generated via in vivo passaging. T47D tumors were established by the subcutaneous implantation of $10\times10^6$ T47DvII cells mixed 1:1 with Matrigel on the right flank of female SCID mice previously implanted with a 90-Day slow release estroge pellet (Innovative Research of America). Tumors were grown to 100-200 $mm^3$ before treatment initiation, approximately 20 days post-implantation. Mice were randomized into groups of 7 and treated with a single dose of test or control ADO. Tumor growth was monitored for 45 days post-treatment.

Experimental Results:

The single dose in vivo efficacy of PRLR DXd ADO was compared to PRLR DM1 ADO (Table 35). Neither Control DM1 nor Control DXd ADCs delayed tumor growth relative to vehicle treated tumors. A single dose of 10 mg/kg PRLR DM1 ADO caused significant regression of tumors. However, greater tumor regression was observed with both 5 and 10 mg/kg PRLR Dxd ADO. No treatment related changes in weight were observed; all groups were observed to gain approximately 10-15% of body weight over the course of the study.

TABLE 35

Anti-PRLR ADCs mediated regression of T47D xenografts relative to controls (Day 45 post-treatment).

| Article | ADC Dose | Tumor volume ($mm^3$) at termination of vehicle group (mean ± SD) | Tumor growth ($mm^3$) from start of treatment (mean ± SD) |
|---|---|---|---|
| Vehicle | n/a | 815 ± 384 | 639 ± 362 |
| Control DM1 ADC | 10 mg/kg | 823 ± 269 | 650 ± 247 |
| PRLR DM1 ADC | 10 mg/kg | 120 ± 56 | −49 ± 74 |
| Control Dxd ADC | 10 mg/kg | 801 ± 191 | 643 ± 186 |
| PRLR Dxd ADC | 5 mg/kg | 55 ± 18 | −118 ± 39 |
| PRLR Dxd ADC | 10 mg/kg | 42 ± 14 | −124 ± 20 |

As shown above, anti-PRLR ADCs demonstrated significant anti-tumor efficacy against PRLR positive T47D cell line xenografts.

Example 29: In Vivo MET ADO Efficacy Study

This experiment assessed anti-MET ADO efficacy in EBC1 xenografts. The anti-MET/MET bispecific antibody utilized in this Example is described in US2018/0134794, incorporated by reference herein in its entirety.

TABLE 36
| MET ADCs | | | | | | | | |
|---|---|---|---|---|---|---|---|---|
| Description | Target/mAb | Fc modification | Site of Conjugation | Azido Linker | Linker Payload | Payload | Structure of Modification | Dose |
| Control Dxd ADC | Non-targeting control | WT | Q295 | BL7 | LP1 (vcPAB-G-Dxd) | P2 (Dxd) | 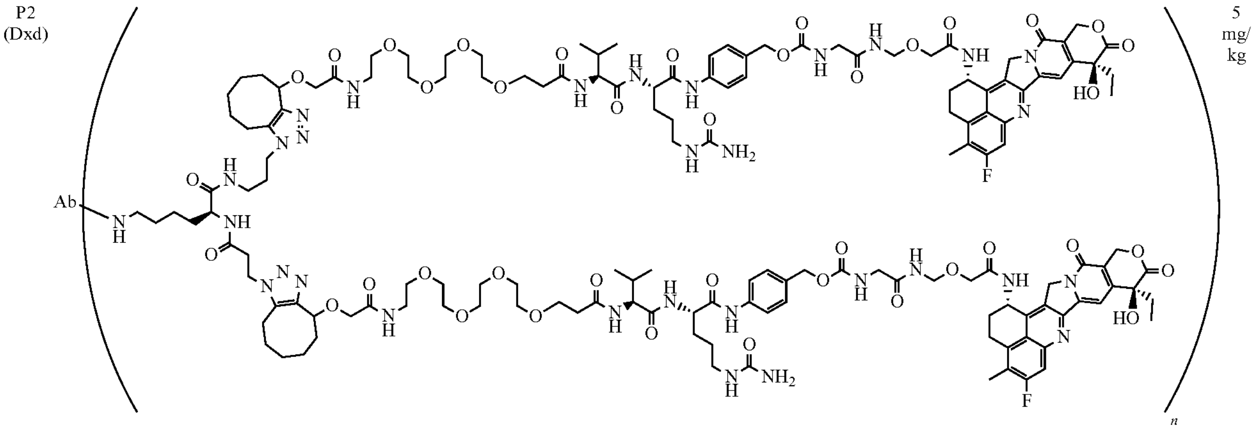 | 5 mg/kg |
| Bi-specific MET/MET Dxd ADC | MET/MET | N297Q | Q295 and Q297 | AL1 | LP1 (vcPAB-G-Dxd) | P2 (Dxd) | 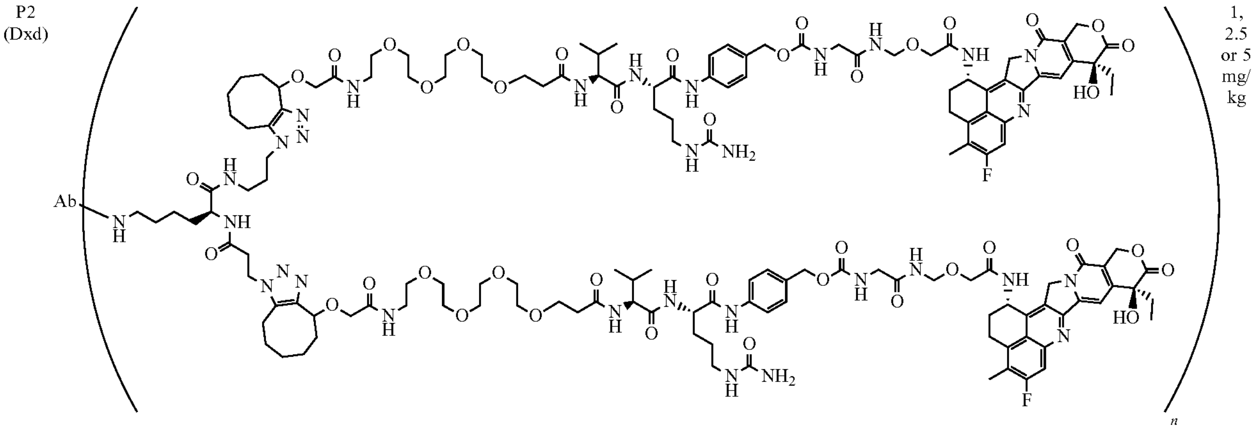 | 1, 2.5 or 5 mg/kg |

Experimental Procedure:

The anti-tumor efficacy of an anti-MET bispecific MET/MET Dxd ADO was assessed in the EBC1 NSCLC xenograft. Tumors were established by the subcutaneous implantation of 5×10$^6$ cells on the right flank of male SCID mice. Tumors were grown to ~130 mm$^3$ before treatment initiation. Mice were randomized into groups of 6 and treated with a single dose of test or control ADO. Tumor growth was monitored for 21 days post-treatment.

Experimental Results:

Activity of MET/MET Dxd ADO were assessed in the EBC1 tumor xenograft model (Table 37). Here a single administration of MET/MET Dxd ADO was compared at doses of 1, 2.5 and 5 mg/kg. Administration of 1 mg/kg MET/MET Dxd ADO showed tumor growth delay relative to the respective control ADO. Treatment with MET/MET Dxd ADO at 2.5 and 5 mg/kg mediated significant and durable regression of tumor xenografts.

TABLE 37

MET/MET Dxd ADC mediated regression of EBC1 xenografts relative to controls (Day 21 post-treatment).

| Article | ADC Dose | Tumor growth (mm$^3$) from start of treatment (mean ± SD) |
|---|---|---|
| Control Dxd ADC | 5 mg/kg | 901 ± 90 |
| MET/MET Dxd ADC | 1 mg/kg | 408 ± 164 |
| MET/MET Dxd ADC | 2.5 mg/kg | −120 ± 0 |
| MET/MET Dxd ADC | 5 mg/kg | −122 ± 0 |

As shown above, MET ADCs demonstrated significant anti-tumor efficacy against MET-amplified NSCLC cell line xenografts.

Example 30: In Vivo EGFRvIII ADO Efficacy Study

This experiment assessed anti-EGFRvIII ADO efficacy in U251/EGFRvIII xenograft models.

TABLE 38
| EGFRvIII ADCs | | | | | | | | | |
|---|---|---|---|---|---|---|---|---|---|
| Description | Target/ mAb | Fc modification | Site of Conjugation | Azido Linker | Linker Payload | Payload | Structure of Modification | DAR | Dose |
| Control Dxd ADC | Non-targeting control | N297Q | Q295, Q297 | BL7 | LP1 (vcPAB-G-Dxd) | P2 (Dxd) | 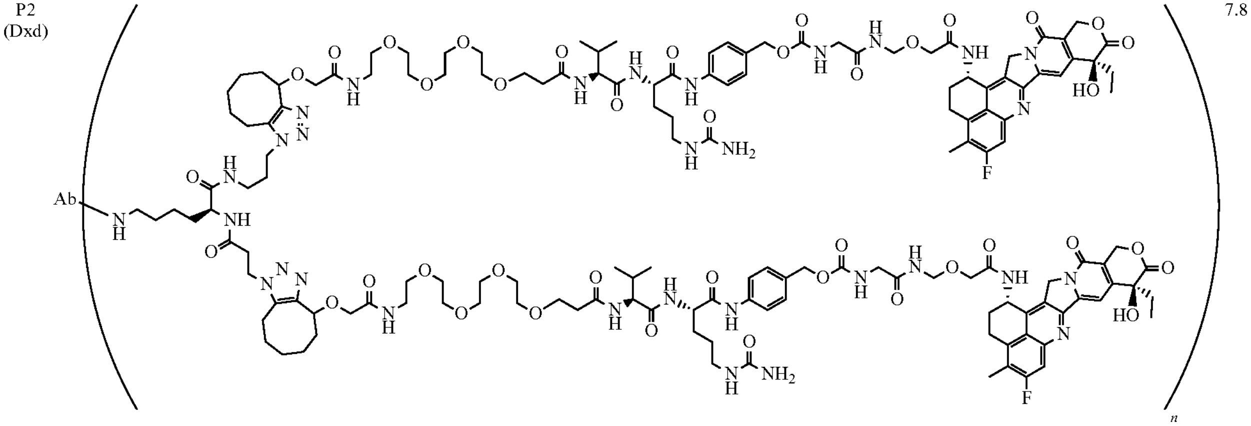 | 7.8 | 3 mg/kg |
| EGFR vIII Dxd ADC | EGFR vIII | N297Q | Q295, Q297 | BL7 | LP1 (vcPAB-G-Dxd) | P2 (Dxd) | 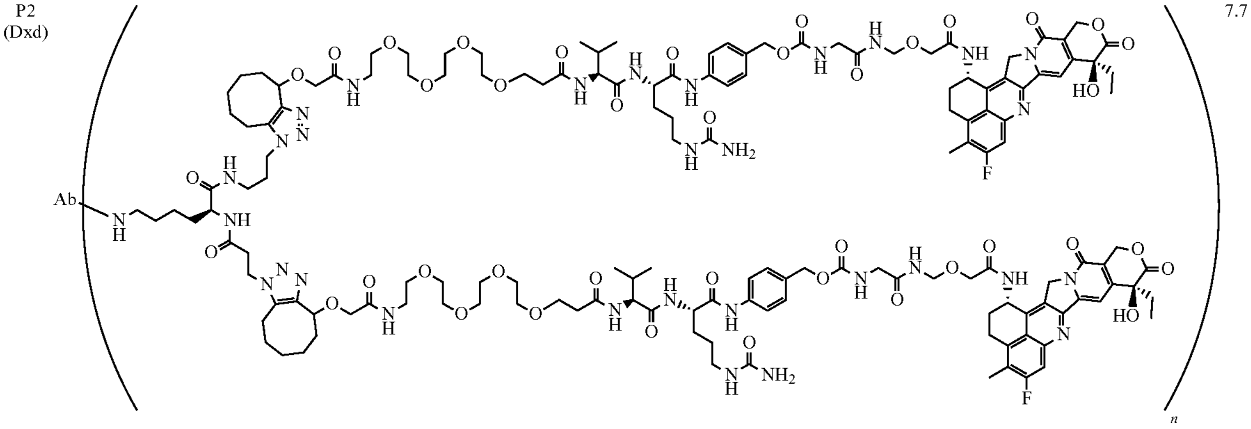 | 7.7 | 0.5, 1 or 3 mg/kg |

Experimental Procedure:

The anti-tumor efficacy of EGFRvIII Dxd ADO was assessed in U251 glioblastoma cell line xenografts models transfected to express EGFRvIII, as endogenous expression of the target is lost following in vitro culture. U251/EGFRvIII were established by the subcutaneous implantation of $10\times10^6$ cells mixed 1:1 with Matrigel on the right flank of male SCID mice. Tumors were grown to ~150 $mm^3$ before treatment initiation, approximately 30 days post-implantation. Mice were randomized into groups of 8 and treated with a single dose of test or control ADC. Tumor growth was monitored for 70 days post-treatment.

Experimental Results:

A study in U251/EGFRvIII xenograft bearing mice assessed the activity of EGFRvIII Dxd ADC following a single dose at 0.5, 1 or 3 mg/kg ADC (Table 39). The growth of xenografts treated with Control Dxd ADC was only slightly delayed relative to vehicle control treated tumors. However, a significant delay in tumor growth was observed in tumors treated with EGFRvIII Dxd ADC. Higher ADC doses resulted in more durable anti-tumor activity. All anti-EGFRvIII treatment groups survived until completion of the study around 70 days post-dosing. All groups were observed to gain approximately 10-15% of body weight over the course of the study.

TABLE 39

EGFRvIII Dxd ADCs mediated regression of U251/EGFRvIII xenografts relative to controls (Day 27 post-treatment).

| Article | ADC Dose | Tumor volume ($mm^3$) at termination of vehicle group (mean ± SD) | Tumor growth ($mm^3$) from start of treatment (mean ± SD) |
|---|---|---|---|
| Vehicle | n/a | 1311 ± 453 | 1159 ± 452 |
| Control Dxd ADC | 3 mg/kg | 805 ± 169 | 657 ± 168 |
| EGFRvIII Dxd ADC | 0.5 mg/kg | 232 ± 34 | 85 ± 41 |
| EGFRvIII Dxd ADC | 1 mg/kg | 138 ± 18 | −11 ± 23 |
| EGFRvIII Dxd ADC | 3 mg/kg | 106 ± 15 | −44 ± 20 |

EGFRvIII Dxd ADC demonstrates significant anti-tumor efficacy against EGFRvIII transfected glioblastoma multiforme cell line xenografts As various changes can be made in the above-described subject matter without departing from the scope and spirit of the present disclosure, it is intended that all subject matter contained in the above description, or defined in the appended claims, be interpreted as descriptive and illustrative of the present disclosure. Many modifications and variations of the present disclosure are possible in light of the above teachings. Accordingly, the present description is intended to embrace all such alternatives, modifications, and variances which fall within the scope of the appended claims.

All patents, applications, publications, test methods, literature, and other materials cited herein are hereby incorporated by reference in their entirety as if physically present in this specification.

SEQUENCE LISTING (2114 sequences)

SEQ ID NO: 1 - DNA, 399 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactataggtccaagtggtataatgattatgcagtatctgtgaaaagtcgaataaccatcaacccagacacatccaagaaccagttctccctgcacctgaactctgtgactcccgaggacacggctgtgtattactgtgcaagggcgggaattgtagtagtaccaggtccggatatttattactactactactacggtatggacgtctggggccaagggaccacggtcaccgtctcctca

SEQ ID NO: 2 - protein, 133 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLHLNSVTPEDTAVYYCARAGIVVVPGPDIYYYYYYGMDVWGQGTTVTVSS

SEQ ID NO: 3 - DNA, 30 bp, Artificial Sequence
  Description of Artificial Sequence: Synthetic oligonucleotide
ggggacagtgtctctagcaacagtgctgct

SEQ ID NO: 4 - protein, 10 aa, Artificial Sequence
  Description of Artificial Sequence: Synthetic peptide
GDSVSSNSAA

SEQ ID NO: 5 - DNA, 27 bp, Artificial Sequence
  Description of Artificial Sequence: Synthetic oligonucleotide
acatactataggtccaagtggtataat

SEQ ID NO: 6 - protein, 9 aa, Artificial Sequence
  Description of Artificial Sequence: Synthetic peptide
TYYRSKWYN

SEQ ID NO: 7 - DNA, 69 bp, Artificial Sequence
  Description of Artificial Sequence: Synthetic oligonucleotide
gcaagggcgggaattgtagtagtaccaggtccggatatttattactactactactacggtatggacgtc

SEQ ID NO: 8 - protein, 23 aa, Artificial Sequence
  Description of Artificial Sequence: Synthetic peptide
ARAGIVVVPGPDIYYYYYYGMDV

SEQ ID NO: 9 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagaagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 10 - protein, 108 aa, Artificial Sequence
  Description of Artificial Sequence: Synthetic polypeptide
DIQMTQSPSSLSASVGDRVTITCRASQSIRSYLNWYQQKPGKAPKLLIYAASSLQSGVPSRFSGSGSGTDFTLTISSLQPEDFATYYCQQSYSTPPITFGQGTRLEIK

SEQ ID NO: 11 - DNA, 18 bp, Artificial Sequence
  Description of Artificial Sequence: Synthetic oligonucleotide
cagagcattagaagctat

SEQ ID NO: 12 - protein, 6 aa, Artificial Sequence
  Description of Artificial Sequence: Synthetic peptide
QSIRSY

SEQ ID NO: 13 - DNA, 9 bp, Artificial Sequence
  Description of Artificial Sequence: Synthetic oligonucleotide
gctgcatcc

SEQ ID NO: 14 - protein, 3 aa, Artificial Sequence
  Description of Artificial Sequence: Synthetic peptide
AAS

SEQ ID NO: 15 - DNA, 30 bp, Artificial Sequence
  Description of Artificial Sequence: Synthetic oligonucleotide
caacagagttacagtacccctccgatcacc

SEQ ID NO: 16 - protein, 10 aa, Artificial Sequence
  Description of Artificial Sequence: Synthetic peptide
QQSYSTPPIT

SEQ ID NO: 17 - DNA, 381 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctacgatatgcactgggtgcgacaggcccctgggcaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaattgggatggtagtatcaggtgctaattactactactactacggtatggacgtctggggccaagggaccacggtcaccgtctcctca

SEQ ID NO: 18 - protein, 127 aa, Artificial Sequence
  Description of Artificial Sequence: Synthetic polypeptide
QVQLVQSGAEVKKPGASVKVSCKASGYTFTGYDMHWVRQAPGQGLEWMGWINPNSGGTNYAQKFQGRVTMTRDTSISTAYMELSRLRSDDTAVYYCARIGMVVSGANYYYYYGMDVWGQGTTVTVSS

SEQ ID NO: 19 - DNA, 24 bp, Artificial Sequence
  Description of Artificial Sequence: Synthetic oligonucleotide
ggatacaccttcaccggctacgat

SEQ ID NO: 20 - protein, 8 aa, Artificial Sequence
  Description of Artificial Sequence: Synthetic peptide
GYTFTGYD

SEQ ID NO: 21 - DNA, 24 bp, Artificial Sequence
  Description of Artificial Sequence: Synthetic oligonucleotide
atcaaccctaacagtggtggcaca

SEQ ID NO: 22 - protein, 8 aa, Artificial Sequence
  Description of Artificial Sequence: Synthetic peptide
INPNSGGT

SEQ ID NO: 23 - DNA, 60 bp, Artificial Sequence
  Description of Artificial Sequence: Synthetic oligonucleotide
gcgagaattgggatggtagtatcaggtgctaattactactactactacggtatggacgtc

SEQ ID NO: 24 - protein, 20 aa, Artificial Sequence
  Description of Artificial Sequence: Synthetic peptide
ARIGMVVSGANYYYYYGMDV

SEQ ID NO: 25 - DNA, 321 bp, Artificial Sequence
  Description of Artificial Sequence: Synthetic polynucleotide
gccatccagatgacccagtctccatcctccctgtctgcatatgtaggagacagagtcatcatcacttgccgggcaagtcagggcattagaaatgatttaggctggtatcagcagaaaccagggaaagcccctaagctcctgatctatgctgcatccagtttacaaagtggggtcccatcaaggttcagcggcagtagatctggcacagttttcactctcaccatcagcagcctgcagcctgaagattttgcaacttattactgtctgcaagattacaattacccgtggacgttcggccaagggaccaaggtggaaatcaaa

SEQ ID NO: 26 - protein, 107 aa, Artificial Sequence
  Description of Artificial Sequence: Synthetic polypeptide
AIQMTQSPSSLSAYVGDRVIITCRASQGIRNDLGWYQQKPGKAPKLLIYAASSLQSGVPSRFSGSRSGTVFTLTISSLQPEDFATYYCLQDYNYPWTFGQGTKVEIK

SEQ ID NO: 27 - DNA, 18 bp, Artificial Sequence
  Description of Artificial Sequence: Synthetic oligonucleotide
cagggcattagaaatgat

SEQ ID NO: 28 - protein, 6 aa, Artificial Sequence
  Description of Artificial Sequence: Synthetic peptide
QGIRND

SEQ ID NO: 29 - DNA, 9 bp, Artificial Sequence
  Description of Artificial Sequence: Synthetic oligonucleotide
gctgcatcc

SEQ ID NO: 30 - protein, 3 aa, Artificial Sequence
  Description of Artificial Sequence: Synthetic peptide
AAS

SEQ ID NO: 31 - DNA, 27 bp, Artificial Sequence
  Description of Artificial Sequence: Synthetic oligonucleotide
ctgcaagattacaattacccgtggacg

SEQ ID NO: 32 - protein, 9 aa, Artificial Sequence
  Description of Artificial Sequence: Synthetic peptide
LQDYNYPWT

SEQ ID NO: 33 - DNA, 360 bp, Artificial Sequence
  Description of Artificial Sequence: Synthetic polynucleotide
gaggtgcagctggtggagtctgggggaggcttggtccagcctggggggtccctgagactctcctgtgcagcctctggattcaccttcagtacctatgctatgcactgggtccgccaggctccagggaagggactgcaacatgtttcaactattagtactaatggggttaacacatattatgcagactctgtgaagggcagattcaccatctccagagacaattccaagagcacgctgtatcttcaaatgggcagcctgagagctgaggacatggctgtatattactgtgcgagagataaagatttttggagtggttattttgactactggggccagggaaccctggtcaccgtctcctca

SEQ ID NO: 34 - protein, 120 aa, Artificial Sequence
  Description of Artificial Sequence: Synthetic polypeptide
EVQLVESGGGLVQPGGSLRLSCAASGFTFSTYAMHWVRQAPGKGLQHVSTISTNGVNTYYADSVKGRFTISRDNSKSTLYLQMGSLRAEDMAVYYCARDKDFWSGYFDYWGQGTLVTVSS

SEQ ID NO: 35 - DNA, 24 bp, Artificial Sequence
  Description of Artificial Sequence: Synthetic oligonucleotide
ggattcaccttcagtacctatgct

SEQ ID NO: 36 - protein, 8 aa, Artificial Sequence
  Description of Artificial Sequence: Synthetic peptide
GFTFSTYA

SEQ ID NO: 37 - DNA, 24 bp, Artificial Sequence
  Description of Artificial Sequence: Synthetic oligonucleotide
attagtactaatggggttaacaca

SEQ ID NO: 38 - protein, 8 aa, Artificial Sequence
  Description of Artificial Sequence: Synthetic peptide
ISTNGVNT

SEQ ID NO: 39 - DNA, 39 bp, Artificial Sequence
  Description of Artificial Sequence: Synthetic oligonucleotide
gcgagagataaagatttttggagtggttattttgactac

SEQ ID NO: 40 - protein, 13 aa, Artificial Sequence
  Description of Artificial Sequence: Synthetic peptide
ARDKDFWSGYFDY

SEQ ID NO: 41 - DNA, 321 bp, Artificial Sequence
  Description of Artificial Sequence: Synthetic polynucleotide
gaaattgtgatgacgcagtctccaggcaccctgtctgtgtctccaggggaaagagccaccctctcctgtagggccagtcagagtgttagtagcaacttagcctggtaccaccagaaacctggccaggctcccaggctcctcatctatggtgcatccaccagggccactggtttcccagccaggttcagtggcagtgggtctgggacagagttcactctcaccatcagcagcctgcagtcggaagattttgcagcttattactgtcagcagtataataattggcccatcaccttcggccaagggacacgactggagattaaa

SEQ ID NO: 42 - protein, 107 aa, Artificial Sequence
  Description of Artificial Sequence: Synthetic polypeptide
EIVMTQSPGTLSVSPGERATLSCRASQSVSSNLAWYHQKPGQAPRLLIYGASTRATGFPARFSGSGSGTEFTLTISSLQSEDFAAYYCQQYNNWPITFGQGTRLEIK

SEQ ID NO: 43 - DNA, 18 bp, Artificial Sequence
  Description of Artificial Sequence: Synthetic oligonucleotide
cagagtgttagtagcaac

SEQ ID NO: 44 - protein, 6 aa, Artificial Sequence
  Description of Artificial Sequence: Synthetic peptide
QSVSSN

SEQ ID NO: 45 - DNA, 9 bp, Artificial Sequence
  Description of Artificial Sequence: Synthetic oligonucleotide
ggtgcatcc

SEQ ID NO: 46 - protein, 3 aa, Artificial Sequence
  Description of Artificial Sequence: Synthetic peptide
GAS

SEQ ID NO: 47 - DNA, 27 bp, Artificial Sequence
  Description of Artificial Sequence: Synthetic oligonucleotide
cagcagtataataattggcccatcacc

SEQ ID NO: 48 - protein, 9 aa, Artificial Sequence
  Description of Artificial Sequence: Synthetic peptide
QQYNNWPIT

SEQ ID NO: 49 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggttactccatcaacagtggtggtcatttctggagctggatccgccagcacccagggaagggcctggagtggattggggacatctattacagtgggaacacctactccattccgtccctcaagcgtcgaatttccatgtcagtagacacgtctaagaaccacttctccctgaaactgatctctgtgacggccgcggacacggccatttattactgtgcgagaaatagtgggggctatcttgatgcttttgatatctggggccaagggacaatggtcaccgtctcttca

SEQ ID NO: 50 - protein, 121 aa, Artificial Sequence
  Description of Artificial Sequence: Synthetic polypeptide
QVQLQESGPGLVKPSQTLSLTCTVSGYSINSGGHFWSWIRQHPGKGLEWIGDIYYSGNTYSIPSLKRRISMSVDTSKNHFSLKLISVTAADTAIYYCARNSGGYLDAFDIWGQGTMVTVSS

SEQ ID NO: 51 - DNA, 30 bp, Artificial Sequence
  Description of Artificial Sequence: Synthetic oligonucleotide
ggttactccatcaacagtggtggtcatttc

SEQ ID NO: 52 - protein, 10 aa, Artificial Sequence
  Description of Artificial Sequence: Synthetic peptide
GYSINSGGHF

SEQ ID NO: 53 - DNA, 21 bp, Artificial Sequence
  Description of Artificial Sequence: Synthetic oligonucleotide
atctattacagtgggaacacc

SEQ ID NO: 54 - protein, 7 aa, Artificial Sequence
  Description of Artificial Sequence: Synthetic peptide
IYYSGNT

SEQ ID NO: 55 - DNA, 39 bp, Artificial Sequence
  Description of Artificial Sequence: Synthetic oligonucleotide
gcgagaaatagtgggggctatcttgatgcttttgatatc

SEQ ID NO: 56 - protein, 13 aa, Artificial Sequence
  Description of Artificial Sequence: Synthetic peptide
ARNSGGYLDAFDI

SEQ ID NO: 57 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 58 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 59 - DNA, 18 bp, Artificial Sequence
  Description of Artificial Sequence: Synthetic oligonucleotide
cagagcattagcagctat

SEQ ID NO: 60 - protein, 6 aa, Artificial Sequence
  Description of Artificial Sequence: Synthetic peptide
QSISSY

SEQ ID NO: 61 - DNA, 9 bp, Artificial Sequence
  Description of Artificial Sequence: Synthetic oligonucleotide
gctgcatcc

SEQ ID NO: 62 - protein, 3 aa, Artificial Sequence
  Description of Artificial Sequence: Synthetic peptide
AAS

SEQ ID NO: 63 - DNA, 30 bp, Artificial Sequence; identical to SEQ ID NO: 15
  Description of Artificial Sequence: Synthetic oligonucleotide

SEQ ID NO: 64 - protein, 10 aa, Artificial Sequence
  Description of Artificial Sequence: Synthetic peptide
QQSYSTPPIT

SEQ ID NO: 65 - DNA, 387 bp, Artificial Sequence
  Description of Artificial Sequence: Synthetic polynucleotide
gaggtgcagctggtggagtctgggggaggcttggtacagccgggggggtccctgagactctcctgtgcaacctctggattcaccttcagtaactacgacttccactgggtccgccaaattagaggacaaggtctggagtgggtctctactattgacactgctggtgacacatacttttcaggctccgtgaagggccgcttcaccatctccagagacactgccaaaacctccttgtatcttcaaatgaacagcctgagagccggggacacggctgtgtattactgtgcaagagcccctcgttatgatagtactggtaactactacaattactattcctatttcggcctggacgtctggggccaagggaccacggtcaccgtctcctca

SEQ ID NO: 66 - protein, 129 aa, Artificial Sequence
  Description of Artificial Sequence: Synthetic polypeptide
EVQLVESGGGLVQPGGSLRLSCATSGFTFSNYDFHWVRQIRGQGLEWVSTIDTAGDTYFSGSVKGRFTISRDTAKTSLYLQMNSLRAGDTAVYYCARAPRYDSTGNYYNYYSYFGLDVWGQGTTVTVSS

SEQ ID NO: 67 - DNA, 24 bp, Artificial Sequence
  Description of Artificial Sequence: Synthetic oligonucleotide
ggattcaccttcagtaactacgac

SEQ ID NO: 68 - protein, 8 aa, Artificial Sequence
  Description of Artificial Sequence: Synthetic peptide
GFTFSNYD

SEQ ID NO: 69 - DNA, 21 bp, Artificial Sequence
  Description of Artificial Sequence: Synthetic oligonucleotide
attgacactgctggtgacaca

SEQ ID NO: 70 - protein, 7 aa, Artificial Sequence
  Description of Artificial Sequence: Synthetic peptide
IDTAGDT

SEQ ID NO: 71 - DNA, 69 bp, Artificial Sequence
  Description of Artificial Sequence: Synthetic oligonucleotide
gcaagagcccctcgttatgatagtactggtaactactacaattactattcctatttcggcctggacgtc

SEQ ID NO: 72 - protein, 23 aa, Artificial Sequence
  Description of Artificial Sequence: Synthetic peptide
ARAPRYDSTGNYYNYYSYFGLDV

SEQ ID NO: 73 - DNA, 375 bp, Artificial Sequence
  Description of Artificial Sequence: Synthetic polynucleotide
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaagttttgatcctgaagatgatgaaacaatctacgcacagaagttccagggcagagtcaccatgaccgaggacacatctacagacacagcctacatggacctgagcagcctaagatctgaggacacggccgtgtattactgttcaatagaggaagttcgttggcggggatcggactactactacgttatggacgtctggggccaagggaccacggtcaccgtctcctca

SEQ ID NO: 74 - protein, 125 aa, Artificial Sequence
  Description of Artificial Sequence: Synthetic polypeptide
QVQLVQSGAEVKKPGASVKVSCKVSGYTLTELSMHWVRQAPGKGLEWMGSFDPEDDETIYAQKFQGRVTMTEDTSTDTAYMDLSSLRSEDTAVYYCSIEEVRWRGSDYYYVMDVWGQGTTVTVSS

SEQ ID NO: 75 - DNA, 24 bp, Artificial Sequence
  Description of Artificial Sequence: Synthetic oligonucleotide
ggatacaccctcactgaattatcc

SEQ ID NO: 76 - protein, 8 aa, Artificial Sequence
  Description of Artificial Sequence: Synthetic peptide
GYTLTELS

SEQ ID NO: 77 - DNA, 24 bp, Artificial Sequence
  Description of Artificial Sequence: Synthetic oligonucleotide
tttgatcctgaagatgatgaaaca

SEQ ID NO: 78 - protein, 8 aa, Artificial Sequence
  Description of Artificial Sequence: Synthetic peptide
FDPEDDET

SEQ ID NO: 79 - DNA, 54 bp, Artificial Sequence
  Description of Artificial Sequence: Synthetic oligonucleotide
tcaatagaggaagttcgttggcggggatcggactactactacgttatggacgtc

SEQ ID NO: 80 - protein, 18 aa, Artificial Sequence
  Description of Artificial Sequence: Synthetic peptide
SIEEVRWRGSDYYYVMDV

SEQ ID NO: 81 - DNA, 372 bp, Artificial Sequence
  Description of Artificial Sequence: Synthetic polynucleotide
caggtgcagctggtgcagtctggggctgaggtgaagaagcctgggtcctcggtgaaggtctcctgcagggcttctggaggcaccttcagcagatttgctatcggctgggtgcgacaggcccctggacaagggcttgagtggatgggagggatcatccctatctttggtacagcaagctacgcacagaagttccagggcagagtcacgattaccacggacgaatccacgagcacagcctacatggagttgcgaagcctgagatctgaggacacggccgtatattactgtacgagagaaggtataactggtcgaggctactactactacggtatggacgtctggggccaagggaccacggtcaccgtctcctca

SEQ ID NO: 82 - protein, 124 aa, Artificial Sequence
  Description of Artificial Sequence: Synthetic polypeptide
QVQLVQSGAEVKKPGSSVKVSCRASGGTFSRFAIGWVRQAPGQGLEWMGGIIPIFGTASYAQKFQGRVTITTDESTSTAYMELRSLRSEDTAVYYCTREGITGRGYYYYGMDVWGQGTTVTVSS

SEQ ID NO: 83 - DNA, 24 bp, Artificial Sequence
  Description of Artificial Sequence: Synthetic oligonucleotide
ggaggcaccttcagcagatttgct

SEQ ID NO: 84 - protein, 8 aa, Artificial Sequence
  Description of Artificial Sequence: Synthetic peptide
GGTFSRFA

SEQ ID NO: 85 - DNA, 24 bp, Artificial Sequence
  Description of Artificial Sequence: Synthetic oligonucleotide
atcatccctatctttggtacagca

SEQ ID NO: 86 - protein, 8 aa, Artificial Sequence
  Description of Artificial Sequence: Synthetic peptide
IIPIFGTA

SEQ ID NO: 87 - DNA, 51 bp, Artificial Sequence
  Description of Artificial Sequence: Synthetic oligonucleotide
acgagagaaggtataactggtcgaggctactactactacggtatggacgtc

SEQ ID NO: 88 - protein, 17 aa, Artificial Sequence
  Description of Artificial Sequence: Synthetic peptide
TREGITGRGYYYYGMDV

SEQ ID NO: 89 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtatttactactggacctggatccggcagcccccagggaagggactggagtggattgggaatatcttttacagtgggagcaccaactacaacccctccctcaagagtcgagtcaccatatcagtagacacgtccaagaatcagttttccctgaagttgagctctgtgaccgctgcggacacggccgtgtattactgtgcgagagagagactggggcgttacgatgcttttgataattggggccaagggacaatggtcaccgtctcttca

SEQ ID NO: 90 - protein, 119 aa, Artificial Sequence
  Description of Artificial Sequence: Synthetic polypeptide
QVQLQESGPGLVKPSETLSLTCTVSGGSISIYYWTWIRQPPGKGLEWIGNIFYSGSTNYNPSLKSRVTISVDTSKNQFSLKLSSVTAADTAVYYCARERLGRYDAFDNWGQGTMVTVSS

SEQ ID NO: 91 - DNA, 24 bp, Artificial Sequence
  Description of Artificial Sequence: Synthetic oligonucleotide
ggtggctccatcagtatttactac

SEQ ID NO: 92 - protein, 8 aa, Artificial Sequence
  Description of Artificial Sequence: Synthetic peptide
GGSISIYY

SEQ ID NO: 93 - DNA, 21 bp, Artificial Sequence
  Description of Artificial Sequence: Synthetic oligonucleotide
atcttttacagtgggagcacc

SEQ ID NO: 94 - protein, 7 aa, Artificial Sequence
  Description of Artificial Sequence: Synthetic peptide
IFYSGST

SEQ ID NO: 95 - DNA, 39 bp, Artificial Sequence
  Description of Artificial Sequence: Synthetic oligonucleotide
gcgagagagagactggggcgttacgatgcttttgataat

SEQ ID NO: 96 - protein, 13 aa, Artificial Sequence
  Description of Artificial Sequence: Synthetic peptide
ARERLGRYDAFDN

SEQ ID NO: 97 - DNA, 366 bp, Artificial Sequence
  Description of Artificial Sequence: Synthetic polynucleotide
gaggtgcagctggtggagtctgggggaggcttggtacagcctggggggtccctgagactctcctgtgcagcctctagattcacctttagtagctatgccatgagttgggtccgccaggctccagggaaggggctggagtgggtctcacttattagtggtagtggtggtaggacatggtacgcagactccgtgaagggccggttcaccatctccagagacaattccaagaacacgctgtttctgcaaatgaacagcctgagagccgaggacacggccgtctattactgtgcgaaagaaggggggatttttggagtggttaccttctttgactactggggccagggaaccctggtcaccgtctcctca

SEQ ID NO: 98 - protein, 122 aa, Artificial Sequence
  Description of Artificial Sequence: Synthetic polypeptide
EVQLVESGGGLVQPGGSLRLSCAASRFTFSSYAMSWVRQAPGKGLEWVSLISGSGGRTWYADSVKGRFTISRDNSKNTLFLQMNSLRAEDTAVYYCAKEGGIFGVVTFFDYWGQGTLVTVSS

SEQ ID NO: 99 - DNA, 24 bp, Artificial Sequence
  Description of Artificial Sequence: Synthetic oligonucleotide
agattcacctttagtagctatgcc

SEQ ID NO: 100 - protein, 8 aa, Artificial Sequence
  Description of Artificial Sequence: Synthetic peptide
RFTFSSYA

SEQ ID NO: 101 - DNA, 24 bp, Artificial Sequence
  Description of Artificial Sequence: Synthetic oligonucleotide
attagtggtagtggtggtaggaca

SEQ ID NO: 102 - protein, 8 aa, Artificial Sequence
  Description of Artificial Sequence: Synthetic peptide
ISGSGGRT

SEQ ID NO: 103 - DNA, 45 bp, Artificial Sequence
  Description of Artificial Sequence: Synthetic oligonucleotide
gcgaaagaaggggggatttttggagtggttaccttctttgactac

SEQ ID NO: 104 - protein, 15 aa, Artificial Sequence
  Description of Artificial Sequence: Synthetic peptide
AKEGGIFGVVTFFDY

SEQ ID NO: 105 - DNA, 360 bp, Artificial Sequence
  Description of Artificial Sequence: Synthetic polynucleotide
gaggtgcagctggtggagtctgggggaggcttggtacagcctggggggtccctgagactctcctgtgcagtctctggattcacctttagcagctatgccatgagctgggtccgccaggctccagggaaggggctggagtgggtctcagttattagtggtagtggtgatttcacataccacgcagactccgtgaagggccggttcaccatctccagagacaattccaagtccacgctgtatctgcaattgaacagcctgagagccgaggacacggccgtatattactgtgcgaaaaagggcttacgatattttgactggtacgactactggggccagggaaccctggtcaccgtctcctca

SEQ ID NO: 106 - protein, 120 aa, Artificial Sequence
  Description of Artificial Sequence: Synthetic polypeptide
EVQLVESGGGLVQPGGSLRLSCAVSGFTFSSYAMSWVRQAPGKGLEWVSVISGSGDFTYHADSVKGRFTISRDNSKSTLYLQLNSLRAEDTAVYYCAKKGLRYFDWYDYWGQGTLVTVSS

SEQ ID NO: 107 - DNA, 24 bp, Artificial Sequence
  Description of Artificial Sequence: Synthetic oligonucleotide
ggattcacctttagcagctatgcc

SEQ ID NO: 108 - protein, 8 aa, Artificial Sequence
  Description of Artificial Sequence: Synthetic peptide
GFTFSSYA

SEQ ID NO: 109 - DNA, 24 bp, Artificial Sequence
  Description of Artificial Sequence: Synthetic oligonucleotide
attagtggtagtggtgatttcaca

SEQ ID NO: 110 - protein, 8 aa, Artificial Sequence
  Description of Artificial Sequence: Synthetic peptide
ISGSGDFT

SEQ ID NO: 111 - DNA, 39 bp, Artificial Sequence
  Description of Artificial Sequence: Synthetic oligonucleotide
gcgaaaaagggcttacgatattttgactggtacgactac

SEQ ID NO: 112 - protein, 13 aa, Artificial Sequence
  Description of Artificial Sequence: Synthetic peptide
AKKGLRYFDWYDY

SEQ ID NO: 113 - DNA, 324 bp, Artificial Sequence
  Description of Artificial Sequence: Synthetic polynucleotide
gaaatagttttgacacagagtcccggcacactgtcactctctcccggggaaagagccaccttgtcatgtagagcaagtcagtcagtctctagctcttatctcgcctggtaccagcagaagccgggacaggcccctagactgctgatctacggggcaagttccagggccaccggaatccccgaccggttcagtggaagcggaagcggaaccgattttactttgacgatttctagactggagccagaggatttcgccgtttactattgtcaacagtacggaagcagcccgtggacgtttggccagggcacgaaggtagaaatcaag

SEQ ID NO: 114 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 115 - DNA, 36 bp, Artificial Sequence
  Description of Artificial Sequence: Synthetic oligonucleotide
agagcaagtcagtcagtctctagctcttatctcgcc

SEQ ID NO: 116 - protein, 12 aa, Artificial Sequence
  Description of Artificial Sequence: Synthetic peptide
RASQSVSSSYLA

SEQ ID NO: 117 - DNA, 21 bp, Artificial Sequence
  Description of Artificial Sequence: Synthetic oligonucleotide
ggggcaagttccagggccacc

SEQ ID NO: 118 - protein, 7 aa, Artificial Sequence
  Description of Artificial Sequence: Synthetic peptide
GASSRAT

SEQ ID NO: 119 - DNA, 27 bp, Artificial Sequence
  Description of Artificial Sequence: Synthetic oligonucleotide
caacagtacggaagcagcccgtggacg

SEQ ID NO: 120 - protein, 9 aa, Artificial Sequence
  Description of Artificial Sequence: Synthetic peptide
QQYGSSPWT

SEQ ID NO: 121 - DNA, 375 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggacctggatccggcagaccccagggaagggactggagtggattgggtatatttattacagtgggagcaccaactacaacccctccctcaagagtcgagtcaccatatcagtagacacgtccaagaaccagttctccctgaagctgaggtctgtggccgctgcggacacggccgtttattactgtgcgagagggacttactaccgtgatagtagtggaaaatatttcaactggttcgacccctggggccagggaaccctggtcaccgtctcctca

SEQ ID NO: 122 - protein, 125 aa, Artificial Sequence
  Description of Artificial Sequence: Synthetic polypeptide
QVQLQESGPGLVKPSETLSLTCTVSGGSISSYYWTWIRQTPGKGLEWIGYIYYSGSTNYNPSLKSRVTISVDTSKNQFSLKLRSVAAADTAVYYCARGTYYRDSSGKYFNWFDPWGQGTLVTVSS

SEQ ID NO: 123 - DNA, 24 bp, Artificial Sequence
  Description of Artificial Sequence: Synthetic oligonucleotide
ggtggctccatcagtagttactac

SEQ ID NO: 124 - protein, 8 aa, Artificial Sequence
  Description of Artificial Sequence: Synthetic peptide
GGSISSYY

SEQ ID NO: 125 - DNA, 21 bp, Artificial Sequence
  Description of Artificial Sequence: Synthetic oligonucleotide
atttattacagtgggagcacc

SEQ ID NO: 126 - protein, 7 aa, Artificial Sequence
  Description of Artificial Sequence: Synthetic peptide
IYYSGST

SEQ ID NO: 127 - DNA, 57 bp, Artificial Sequence
  Description of Artificial Sequence: Synthetic oligonucleotide
gcgagagggacttactaccgtgatagtagtggaaaatatttcaactggttcgacccc

SEQ ID NO: 128 - protein, 19 aa, Artificial Sequence
  Description of Artificial Sequence: Synthetic peptide
ARGTYYRDSSGKYFNWFDP

SEQ ID NO: 129 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattagcaactggttagcctggtatcagcagaaaccagggaaagcccctaagctcctgatctatgctgcatccagtttgcaaagtggggtcccatccaggttcagtggtagtggatctgggacagatttcactctctccatcagcagcctgcagtctgaagattttgcaacttactattgtcaacaggctaaaggtttccctcggacgttcggccaagggaccaaggtggaaatcaaa

SEQ ID NO: 130 - protein, 107 aa, Artificial Sequence
  Description of Artificial Sequence: Synthetic polypeptide
DIQMTQSPSSVSASVGDRVTITCRASQDISNWLAWYQQKPGKAPKLLIYAASSLQSGVPSRFSGSGSGTDFTLSISSLQSEDFATYYCQQAKGFPRTFGQGTKVEIK

SEQ ID NO: 131 - DNA, 18 bp, Artificial Sequence
  Description of Artificial Sequence: Synthetic oligonucleotide
caggatattagcaactgg

SEQ ID NO: 132 - protein, 6 aa, Artificial Sequence
  Description of Artificial Sequence: Synthetic peptide
QDISNW

SEQ ID NO: 133 - DNA, 9 bp, Artificial Sequence
  Description of Artificial Sequence: Synthetic oligonucleotide
gctgcatcc

SEQ ID NO: 134 - protein, 3 aa, Artificial Sequence
  Description of Artificial Sequence: Synthetic peptide
AAS

SEQ ID NO: 135 - DNA, 27 bp, Artificial Sequence
  Description of Artificial Sequence: Synthetic oligonucleotide
caacaggctaaaggtttccctcggacg

SEQ ID NO: 136 - protein, 9 aa, Artificial Sequence
  Description of Artificial Sequence: Synthetic peptide
QQAKGFPRT

SEQ ID NO: 137 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctttggcatgcactgggtccgccaggctccaggcaaggggctggagtgggtgtcacttatatcatatgatggtgataataaatactatgtagactccgtgaagggccgattcaccatctccagagacaattccgagaacacgctgtatctgcaaatgaacaacctgcgacctgaggacacggctttctattactgtgcgaaagatggatttactagtggctggtacggctcctacaccggtttggacgtctggggccaagggaccacggtcaccgtctcctca

SEQ ID NO: 138 - protein, 125 aa, Artificial Sequence
  Description of Artificial Sequence: Synthetic polypeptide
QVQLVESGGGVVQPGRSLRLSCAASGFTFSSFGMHWVRQAPGKGLEWVSLISYDGDNKYYVDSVKGRFTISRDNSENTLYLQMNNLRPEDTAFYYCAKDGFTSGWYGSYTGLDVWGQGTTVTVSS

SEQ ID NO: 139 - DNA, 24 bp, Artificial Sequence
  Description of Artificial Sequence: Synthetic oligonucleotide
ggattcaccttcagtagctttggc

SEQ ID NO: 140 - protein, 8 aa, Artificial Sequence
  Description of Artificial Sequence: Synthetic peptide
GFTFSSFG

SEQ ID NO: 141 - DNA, 24 bp, Artificial Sequence
  Description of Artificial Sequence: Synthetic oligonucleotide
atatcatatgatggtgataataaa

SEQ ID NO: 142 - protein, 8 aa, Artificial Sequence
  Description of Artificial Sequence: Synthetic peptide
ISYDGDNK

SEQ ID NO: 143 - DNA, 54 bp, Artificial Sequence
  Description of Artificial Sequence: Synthetic oligonucleotide
gcgaaagatggatttactagtggctggtacggctcctacaccggtttggacgtc

SEQ ID NO: 144 - protein, 18 aa, Artificial Sequence
  Description of Artificial Sequence: Synthetic peptide
AKDGFTSGWYGSYTGLDV

SEQ ID NO: 145 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaatccagggagagcccctaagcgcctgatctatgctgcatccagtttgcaaagtggggtcccatcaaggttcagcggcagtggatctgggacagaattcactctcacaatcagcagcctgcagcctgaagattttgcaacttattactgtcttcagtataatagttaccctcggacgttcggccaagggaccaaggtggaaatcaaa

SEQ ID NO: 146 - protein, 107 aa, Artificial Sequence
  Description of Artificial Sequence: Synthetic polypeptide
DIQMTQSPSSLSASVGDRVTITCRASQGIRNDLGWYQQNPGRAPKRLIYAASSLQSGVPSRFSGSGSGTEFTLTISSLQPEDFATYYCLQYNSYPRTFGQGTKVEIK

SEQ ID NO: 147 - DNA, 18 bp, Artificial Sequence
  Description of Artificial Sequence: Synthetic oligonucleotide
cagggcattagaaatgat

SEQ ID NO: 148 - protein, 6 aa, Artificial Sequence
  Description of Artificial Sequence: Synthetic peptide
QGIRND

SEQ ID NO: 149 - DNA, 9 bp, Artificial Sequence
  Description of Artificial Sequence: Synthetic oligonucleotide
gctgcatcc

SEQ ID NO: 150 - protein, 3 aa, Artificial Sequence
  Description of Artificial Sequence: Synthetic peptide
AAS

SEQ ID NO: 151 - DNA, 27 bp, Artificial Sequence
  Description of Artificial Sequence: Synthetic oligonucleotide
cttcagtataatagttaccctcggacg

SEQ ID NO: 152 - protein, 9 aa, Artificial Sequence
  Description of Artificial Sequence: Synthetic peptide
LQYNSYPRT

SEQ ID NO: 153 - DNA, 360 bp, Artificial Sequence
  Description of Artificial Sequence: Synthetic polynucleotide
gaggtgcagctggtggagtctgggggaggctgggtacagcctggggggtccctgagactctcctgtgcagcctctggattcacattcagtaacttcgacatgcactgggtccgccaagctgcaggaaaaggtctggagtgggtctcaattattgatactggtggtgacacatactatccgggctccgtgaagggccgattcaccatatccagagaagatgccaagaactccttctatcttcaaatgaacagcctgagagccggggacacggctatatattactgtgtaagaggggggtataccagtggctgggactactttgactactggggccagggaaccctggtcaccgtctcctca

SEQ ID NO: 154 - protein, 120 aa, Artificial Sequence
  Description of Artificial Sequence: Synthetic polypeptide
EVQLVESGGGWVQPGGSLRLSCAASGFTFSNFDMHWVRQAAGKGLEWVSIIDTGGDTYYPGSVKGRFTISREDAKNSFYLQMNSLRAGDTAIYYCVRGGYTSGWDYFDYWGQGTLVTVSS

SEQ ID NO: 155 - DNA, 24 bp, Artificial Sequence
  Description of Artificial Sequence: Synthetic oligonucleotide
ggattcacattcagtaacttcgac

SEQ ID NO: 156 - protein, 8 aa, Artificial Sequence
  Description of Artificial Sequence: Synthetic peptide
GFTFSNFD

SEQ ID NO: 157 - DNA, 21 bp, Artificial Sequence
  Description of Artificial Sequence: Synthetic oligonucleotide
attgatactggtggtgacaca

SEQ ID NO: 158 - protein, 7 aa, Artificial Sequence
  Description of Artificial Sequence: Synthetic peptide
IDTGGDT

SEQ ID NO: 159 - DNA, 42 bp, Artificial Sequence
  Description of Artificial Sequence: Synthetic oligonucleotide
gtaagaggggggtataccagtggctgggactactttgactac

SEQ ID NO: 160 - protein, 14 aa, Artificial Sequence
  Description of Artificial Sequence: Synthetic peptide
VRGGYTSGWDYFDY

SEQ ID NO: 161 - DNA, 321 bp, Artificial Sequence
  Description of Artificial Sequence: Synthetic polynucleotide
gacatccagttgacccagtctccatccttcctgtctgcatctgtgggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatccgccgcctgcagcctgaagattttgcaagttattactgtcaacagcttaataattacccgtacacttttggccaggggaccaagctggagatcaaa

SEQ ID NO: 162 - protein, 107 aa, Artificial Sequence
  Description of Artificial Sequence: Synthetic polypeptide
DIQLTQSPSFLSASVGDRVTITCWASQGISSYLAWYQQKPGKAPKLLIYAASTLQSGVPSRFSGSGSGTEFTLTIRRLQPEDFASYYCQQLNNYPYTFGQGTKLEIK

SEQ ID NO: 163 - DNA, 18 bp, Artificial Sequence
  Description of Artificial Sequence: Synthetic oligonucleotide
cagggcattagcagttat

SEQ ID NO: 164 - protein, 6 aa, Artificial Sequence
  Description of Artificial Sequence: Synthetic peptide
QGISSY

SEQ ID NO: 165 - DNA, 9 bp, Artificial Sequence
  Description of Artificial Sequence: Synthetic oligonucleotide
gctgcatcc

SEQ ID NO: 166 - protein, 3 aa, Artificial Sequence
  Description of Artificial Sequence: Synthetic peptide
AAS

SEQ ID NO: 167 - DNA, 27 bp, Artificial Sequence
  Description of Artificial Sequence: Synthetic oligonucleotide
caacagcttaataattacccgtacact

SEQ ID NO: 168 - protein, 9 aa, Artificial Sequence
  Description of Artificial Sequence: Synthetic peptide
QQLNNYPYT

SEQ ID NO: 169 - DNA, 381 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatggggtctacagtaactacggacgatactactactactacggtatggacgtctggggccaagggaccacggtcaccgtctcctca

SEQ ID NO: 170 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGVYSNYGRYYYYYGMDVWGQGTTVTVSS

SEQ ID NO: 171 - DNA, 24 bp, Artificial Sequence
  Description of Artificial Sequence: Synthetic oligonucleotide
ggattcaccttcagtagctatggc

SEQ ID NO: 172 - protein, 8 aa, Artificial Sequence
  Description of Artificial Sequence: Synthetic peptide
GFTFSSYG

SEQ ID NO: 173 - DNA, 24 bp, Artificial Sequence
  Description of Artificial Sequence: Synthetic oligonucleotide
atatggtatgatggaagtaataaa

SEQ ID NO: 174 - protein, 8 aa, Artificial Sequence
  Description of Artificial Sequence: Synthetic peptide
IWYDGSNK

SEQ ID NO: 175 - DNA, 60 bp, Artificial Sequence
  Description of Artificial Sequence: Synthetic oligonucleotide
gcgagagatggggtctacagtaactacggacgatactactactactacggtatggacgtc

SEQ ID NO: 176 - protein, 20 aa, Artificial Sequence
  Description of Artificial Sequence: Synthetic peptide
ARDGVYSNYGRYYYYYGMDV

SEQ ID NO: 177 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcatacgtagctttttaaattggtatcagcagaaaccagggaaagcccctaagttcctaatttctgctgcatccagtttgcaaagaggggtcccatctaggttcagtggcagtggatctgggacagatttcactctcaccatcagcagtctgcaacctgaggattcttcaacttactactgtcaacagagttacagtatcccggtcactttcggcggagggaccaaggtggagatcaaa

SEQ ID NO: 178 - protein, 107 aa, Artificial Sequence
  Description of Artificial Sequence: Synthetic polypeptide
DIQMTQSPSSLSASVGDRVTITCRASQSIRSFLNWYQQKPGKAPKFLISAASSLQRGVPSRFSGSGSGTDFTLTISSLQPEDSSTYYCQQSYSIPVTFGGGTKVEIK

SEQ ID NO: 179 - DNA, 18 bp, Artificial Sequence
  Description of Artificial Sequence: Synthetic oligonucleotide
cagagcatacgtagcttt

SEQ ID NO: 180 - protein, 6 aa, Artificial Sequence
  Description of Artificial Sequence: Synthetic peptide
QSIRSF

SEQ ID NO: 181 - DNA, 9 bp, Artificial Sequence
  Description of Artificial Sequence: Synthetic oligonucleotide
gctgcatcc

SEQ ID NO: 182 - protein, 3 aa, Artificial Sequence
  Description of Artificial Sequence: Synthetic peptide
AAS

SEQ ID NO: 183 - DNA, 27 bp, Artificial Sequence
  Description of Artificial Sequence: Synthetic oligonucleotide
caacagagttacagtatcccggtcact

SEQ ID NO: 184 - protein, 9 aa, Artificial Sequence
  Description of Artificial Sequence: Synthetic peptide
QQSYSIPVT

SEQ ID NO: 185 - DNA, 372 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgtagtatctgtgaaaagtcgaataatcttcaacccagacacatccaagaaccagttctccctgcagctgaactctgtgactcccgaggacacggctgtgtattactgtgcaagagtgaggcaggattatagaagtggcccgtttgactactggggccagggaaccctggtcaccgtctcctca

SEQ ID NO: 186 - protein, 124 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYVVSVKSRIIFNPDTSKNQFSLQLNSVTPEDTAVYYCARVRQDYRSGPFDYWGQGTLVTVSS

SEQ ID NO: 187 - DNA, 30 bp, Artificial Sequence; identical to SEQ ID NO: 3
  Description of Artificial Sequence: Synthetic oligonucleotide

SEQ ID NO: 188 - protein, 10 aa, Artificial Sequence
  Description of Artificial Sequence: Synthetic peptide
GDSVSSNSAA

SEQ ID NO: 189 - DNA, 27 bp, Artificial Sequence
  Description of Artificial Sequence: Synthetic oligonucleotide
acatactacaggtccaagtggtataat

SEQ ID NO: 190 - protein, 9 aa, Artificial Sequence
  Description of Artificial Sequence: Synthetic peptide
TYYRSKWYN

SEQ ID NO: 191 - DNA, 42 bp, Artificial Sequence
  Description of Artificial Sequence: Synthetic oligonucleotide
gcaagagtgaggcaggattatagaagtggcccgtttgactac

SEQ ID NO: 192 - protein, 14 aa, Artificial Sequence
  Description of Artificial Sequence: Synthetic peptide
ARVRQDYRSGPFDY

SEQ ID NO: 193 - DNA, 321 bp, Artificial Sequence
  Description of Artificial Sequence: Synthetic polynucleotide
gaaatagtgatgacgcagtctccagtcaccctgtctgtgtctccaggggaaagagccaccctctcctgttgggccagtcagagtgttagcagcagcttagcctggtaccagcagaaacctggccaggctcccagactcctcatctatggtgcatccaccagggccactggtatcccagccaggttcagtggcagtgggtctgggacagggttcactctcaccatcagcagcctgcagtctgaagattttgcagtttattactgtcagcagtataataactggccattcactttcggccctgggaccaaagtggatatcaaa

SEQ ID NO: 194 - protein, 107 aa, Artificial Sequence
  Description of Artificial Sequence: Synthetic polypeptide
EIVMTQSPVTLSVSPGERATLSCWASQSVSSSLAWYQQKPGQAPRLLIYGASTRATGIPARFSGSGSGTGFTLTISSLQSEDFAVYYCQQYNNWPFTFGPGTKVDIK

SEQ ID NO: 195 - DNA, 18 bp, Artificial Sequence
  Description of Artificial Sequence: Synthetic oligonucleotide
cagagtgttagcagcagc

SEQ ID NO: 196 - protein, 6 aa, Artificial Sequence
  Description of Artificial Sequence: Synthetic peptide
QSVSSS

SEQ ID NO: 197 - DNA, 9 bp, Artificial Sequence
  Description of Artificial Sequence: Synthetic oligonucleotide
ggtgcatcc

SEQ ID NO: 198 - protein, 3 aa, Artificial Sequence
  Description of Artificial Sequence: Synthetic peptide
GAS

SEQ ID NO: 199 - DNA, 27 bp, Artificial Sequence
  Description of Artificial Sequence: Synthetic oligonucleotide
cagcagtataataactggccattcact

SEQ ID NO: 200 - protein, 9 aa, Artificial Sequence
  Description of Artificial Sequence: Synthetic peptide
QQYNNWPFT

SEQ ID NO: 201 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagcagtatagccggggctttgactactggggccagggaaccctggtcaccgtctcctca

SEQ ID NO: 202 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSVISGSGGSTYYADSVKGRFTISRDNSKNTLYLQMNSLRAEDTAVYYCAKEQYSRGFDYWGQGTLVTVSS

SEQ ID NO: 203 - DNA, 24 bp, Artificial Sequence
  Description of Artificial Sequence: Synthetic oligonucleotide
ggattcacctttagcagctatgcc

SEQ ID NO: 204 - protein, 8 aa, Artificial Sequence
  Description of Artificial Sequence: Synthetic peptide
GFTFSSYA

SEQ ID NO: 205 - DNA, 24 bp, Artificial Sequence
  Description of Artificial Sequence: Synthetic oligonucleotide
attagtggtagtggtggtagcaca

SEQ ID NO: 206 - protein, 8 aa, Artificial Sequence
  Description of Artificial Sequence: Synthetic peptide
ISGSGGST

SEQ ID NO: 207 - DNA, 33 bp, Artificial Sequence
  Description of Artificial Sequence: Synthetic oligonucleotide
gcgaaagagcagtatagccggggctttgactac

SEQ ID NO: 208 - protein, 11 aa, Artificial Sequence
  Description of Artificial Sequence: Synthetic peptide
AKEQYSRGFDY

SEQ ID NO: 209 - DNA, 318 bp, Artificial Sequence
  Description of Artificial Sequence: Synthetic polynucleotide
gacatccagatgacccagtctccttccaccctgtctgtatctgtaggagacagagtcaccatcacttgccgggccagtcagagtattagtagttggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaa

SEQ ID NO: 210 - protein, 106 aa, Artificial Sequence
  Description of Artificial Sequence: Synthetic polypeptide
DIQMTQSPSTLSVSVGDRVTITCRASQSISSWLAWYQQKPGKAPKLLIYKASSLESGVPSRFSGSGSGTEFTLTISSLQPDDFATYYCQQYNSYWTFGQGTKVEIK

SEQ ID NO: 211 - DNA, 18 bp, Artificial Sequence
  Description of Artificial Sequence: Synthetic oligonucleotide
cagagtattagtagttgg

SEQ ID NO: 212 - protein, 6 aa, Artificial Sequence
  Description of Artificial Sequence: Synthetic peptide
QSISSW

SEQ ID NO: 213 - DNA, 9 bp, Artificial Sequence
  Description of Artificial Sequence: Synthetic oligonucleotide
aaggcgtct

SEQ ID NO: 214 - protein, 3 aa, Artificial Sequence
  Description of Artificial Sequence: Synthetic peptide
KAS

SEQ ID NO: 215 - DNA, 24 bp, Artificial Sequence
  Description of Artificial Sequence: Synthetic oligonucleotide
caacagtataatagttattggacg

SEQ ID NO: 216 - protein, 8 aa, Artificial Sequence
  Description of Artificial Sequence: Synthetic peptide
QQYNSYWT

SEQ ID NO: 217 - DNA, 345 bp, Artificial Sequence
  Description of Artificial Sequence: Synthetic polynucleotide
caggtgcagctggtggagtctgggggaggcgtggtccagcctgggaggtccctgagactctcctgtgtagcctctggattcaccatcagtagctatggcatgaactgggtccgccaggctccaggcaaggggctggagtgggtggcagttatatcatatgatggaggtaataaatactctgtagactccgtgaagggccgattcaccatctccagagacaattccaagaatacgctgtatctgcaaatgaacagcctgagagctgaggactcggctgtttattactgtgcgagaggaaggtacttcgatctctggggccgtggcaccctggtcactgtctcctca

SEQ ID NO: 218 - protein, 115 aa, Artificial Sequence
  Description of Artificial Sequence: Synthetic polypeptide
QVQLVESGGGVVQPGRSLRLSCVASGFTISSYGMNWVRQAPGKGLEWVAVISYDGGNKYSVDSVKGRFTISRDNSKNTLYLQMNSLRAEDSAVYYCARGRYFDLWGRGTLVTVSS

SEQ ID NO: 219 - DNA, 24 bp, Artificial Sequence
  Description of Artificial Sequence: Synthetic oligonucleotide
ggattcaccatcagtagctatggc

SEQ ID NO: 220 - protein, 8 aa, Artificial Sequence
  Description of Artificial Sequence: Synthetic peptide
GFTISSYG

SEQ ID NO: 221 - DNA, 24 bp, Artificial Sequence
  Description of Artificial Sequence: Synthetic oligonucleotide
atatcatatgatggaggtaataaa

SEQ ID NO: 222 - protein, 8 aa, Artificial Sequence
  Description of Artificial Sequence: Synthetic peptide
ISYDGGNK

SEQ ID NO: 223 - DNA, 24 bp, Artificial Sequence
  Description of Artificial Sequence: Synthetic oligonucleotide
gcgagaggaaggtacttcgatctc

SEQ ID NO: 224 - protein, 8 aa, Artificial Sequence
  Description of Artificial Sequence: Synthetic peptide
ARGRYFDL

SEQ ID NO: 225 - DNA, 321 bp, Artificial Sequence
  Description of Artificial Sequence: Synthetic polynucleotide
gacatccagatgacccagtctccttccaccctgtctgcatctgtaggagacagagtcaccatcacttgccgggccagtcagagtattagtagctggttggcctggtatcagcagaaaccagggagagcccctaacctcctgatctctaaggcgtctagtttaaaaagtggggtcccatcaaggttcagcggcagtggatctgggacagaattcactctcaccgtcagcagcctgcagcctgatgattttgcaacttattactgccaacagtattatagttattcttacacttttggccaggggaccaagctggagatcaaa

SEQ ID NO: 226 - protein, 107 aa, Artificial Sequence
  Description of Artificial Sequence: Synthetic polypeptide
DIQMTQSPSTLSASVGDRVTITCRASQSISSWLAWYQQKPGRAPNLLISKASSLKSGVPSRFSGSGSGTEFTLTVSSLQPDDFATYYCQQYYSYSYTFGQGTKLEIK

SEQ ID NO: 227 - DNA, 18 bp, Artificial Sequence
  Description of Artificial Sequence: Synthetic oligonucleotide
cagagtattagtagctgg

SEQ ID NO: 228 - protein, 6 aa, Artificial Sequence
  Description of Artificial Sequence: Synthetic peptide
QSISSW

SEQ ID NO: 229 - DNA, 9 bp, Artificial Sequence
  Description of Artificial Sequence: Synthetic oligonucleotide
aaggcgtct

SEQ ID NO: 230 - protein, 3 aa, Artificial Sequence
  Description of Artificial Sequence: Synthetic peptide
KAS

SEQ ID NO: 231 - DNA, 27 bp, Artificial Sequence
  Description of Artificial Sequence: Synthetic oligonucleotide
caacagtattatagttattcttacact

SEQ ID NO: 232 - protein, 9 aa, Artificial Sequence
  Description of Artificial Sequence: Synthetic peptide
QQYYSYSYT

SEQ ID NO: 233 - DNA, 360 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagtcaccatatcagtagacacgtctaagaaccagttctccctgaagctgaactctgtgactgccgcggacacggccgtgtattactgtgcgagggacgacggtgactactacggtatggacgtctggggccaagggaccacggtcaccgtctcctca

SEQ ID NO: 234 - protein, 120 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLNSVTAADTAVYYCARDDGDYYGMDVWGQGTTVTVSS

SEQ ID NO: 235 - DNA, 30 bp, Artificial Sequence
  Description of Artificial Sequence: Synthetic oligonucleotide
ggtggctccatcagcagtggtggttactac

SEQ ID NO: 236 - protein, 10 aa, Artificial Sequence
  Description of Artificial Sequence: Synthetic peptide
GGSISSGGYY

SEQ ID NO: 237 - DNA, 21 bp, Artificial Sequence
  Description of Artificial Sequence: Synthetic oligonucleotide
atctattacagtgggagcacc

SEQ ID NO: 238 - protein, 7 aa, Artificial Sequence
  Description of Artificial Sequence: Synthetic peptide
IYYSGST

SEQ ID NO: 239 - DNA, 36 bp, Artificial Sequence
  Description of Artificial Sequence: Synthetic oligonucleotide
gcgagggacgacggtgactactacggtatggacgtc

SEQ ID NO: 240 - protein, 12 aa, Artificial Sequence
  Description of Artificial Sequence: Synthetic peptide
ARDDGDYYGMDV

SEQ ID NO: 241 - DNA, 324 bp, Artificial Sequence
  Description of Artificial Sequence: Synthetic polynucleotide
gaaattgtgttgacacagtctccagccaccctgtctttgtctccaggggaaagagccaccctctcctgcagggccagtcagactgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccattcactttcggccctgggaccaaagtggatatcaaa

SEQ ID NO: 242 - protein, 108 aa, Artificial Sequence
  Description of Artificial Sequence: Synthetic polypeptide
EIVLTQSPATLSLSPGERATLSCRASQTVSSYLAWYQQKPGQAPRLLIYDASNRATGIPARFSGSGSGTDFTLTISSLEPEDFAVYYCQQRSNWPPFTFGPGTKVDIK

SEQ ID NO: 243 - DNA, 18 bp, Artificial Sequence
  Description of Artificial Sequence: Synthetic oligonucleotide
cagactgttagcagctac

SEQ ID NO: 244 - protein, 6 aa, Artificial Sequence
  Description of Artificial Sequence: Synthetic peptide
QTVSSY

SEQ ID NO: 245 - DNA, 9 bp, Artificial Sequence
  Description of Artificial Sequence: Synthetic oligonucleotide
gatgcatcc

SEQ ID NO: 246 - protein, 3 aa, Artificial Sequence
  Description of Artificial Sequence: Synthetic peptide
DAS

SEQ ID NO: 247 - DNA, 30 bp, Artificial Sequence
  Description of Artificial Sequence: Synthetic oligonucleotide
cagcagcgtagcaactggcctccattcact

SEQ ID NO: 248 - protein, 10 aa, Artificial Sequence
  Description of Artificial Sequence: Synthetic peptide
QQRSNWPPFT

SEQ ID NO: 249 - DNA, 399 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagtaatcgtgctgcttggaactggatcaggcagtccccatcgagaggccttcagtggctgggaaggacatactataggtccaagtggtataatgattatgcagtatctctgagaagtcgaataaccatcaacccagtcacatccaagaaccaggtcgccctgcatatgaactctgtgactcccgaggacacggctgtgtattactgtgcaagggcgggaattgttgtagtgccaggtccggaaactttctactattatgatcacggtttggacgtctggggccaagggaccacggtcaccgtctcctca

SEQ ID NO: 250 - protein, 133 aa, Artificial Sequence
  Description of Artificial Sequence: Synthetic polypeptide
QVQLQQSGPGLVKPSQTLSLTCAISGDSVSSNRAAWNWIRQSPSRGLQWLGRTYYRSKWYNDYAVSLRSRITINPVTSKNQVALHMNSVTPEDTAVYYCARAGIVVVPGPETFYYYDHGLDVWGQGTTVTVSS

SEQ ID NO: 251 - DNA, 30 bp, Artificial Sequence
  Description of Artificial Sequence: Synthetic oligonucleotide
ggggacagtgtctctagtaatcgtgctgct

SEQ ID NO: 252 - protein, 10 aa, Artificial Sequence
  Description of Artificial Sequence: Synthetic peptide
GDSVSSNRAA

SEQ ID NO: 253 - DNA, 27 bp, Artificial Sequence
  Description of Artificial Sequence: Synthetic oligonucleotide
acatactataggtccaagtggtataat

SEQ ID NO: 254 - protein, 9 aa, Artificial Sequence
  Description of Artificial Sequence: Synthetic peptide
TYYRSKWYN

SEQ ID NO: 255 - DNA, 69 bp, Artificial Sequence
  Description of Artificial Sequence: Synthetic oligonucleotide
gcaagggcgggaattgttgtagtgccaggtccggaaactttctactattatgatcacggtttggacgtc

SEQ ID NO: 256 - protein, 23 aa, Artificial Sequence
  Description of Artificial Sequence: Synthetic peptide
ARAGIVVVPGPETFYYYDHGLDV

SEQ ID NO: 257 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagaagctatttaaattggtatcagcagaaaccagggaaagcccctgagctcctgatccatgctgcatccagtttgcaaagtggggtcccttcaaggttcagtggcagtggatctgggacagatttcactctcaccatcagcagtctgcaacctgaagattttgcaagttattactgtcaacagagttacagtgcccctccgatcaccttcggccaagggacacgactggagattaaa

SEQ ID NO: 258 - protein, 108 aa, Artificial Sequence
  Description of Artificial Sequence: Synthetic polypeptide
DIQMTQSPSSLSASVGDRVTITCRASQSIRSYLNWYQQKPGKAPELLIHAASSLQSGVPSRFSGSGSGTDFTLTISSLQPEDFASYYCQQSYSAPPITFGQGTRLEIK

SEQ ID NO: 259 - DNA, 18 bp, Artificial Sequence
  Description of Artificial Sequence: Synthetic oligonucleotide
cagagcattagaagctat

SEQ ID NO: 260 - protein, 6 aa, Artificial Sequence
  Description of Artificial Sequence: Synthetic peptide
QSIRSY

SEQ ID NO: 261 - DNA, 9 bp, Artificial Sequence
  Description of Artificial Sequence: Synthetic oligonucleotide
gctgcatcc

SEQ ID NO: 262 - protein, 3 aa, Artificial Sequence
  Description of Artificial Sequence: Synthetic peptide
AAS

SEQ ID NO: 263 - DNA, 30 bp, Artificial Sequence
  Description of Artificial Sequence: Synthetic oligonucleotide
caacagagttacagtgcccctccgatcacc

SEQ ID NO: 264 - protein, 10 aa, Artificial Sequence
  Description of Artificial Sequence: Synthetic peptide
QQSYSAPPIT

SEQ ID NO: 265 - DNA, 399 bp, Artificial Sequence
  Description of Artificial Sequence: Synthetic polynucleotide
caggtccagctgcagcagtcaggtccaggactggtgaagccctcgcaggccctctcactcacctgtgccatctccggggacagtgtctccagcaacagtgctgcttggaactggatcaggcagtccccctcgagaggccttgagtggctgggaaggacatattataggtccaagtggtataatgattatgcagtgtctgtgaaaagtcgaataaccatcaacccagacacatccaagaaccacttctccctgcacctgaattctatgactcccgaggacacggctgtgtattactgtgcaagggcgagaattgtagtcgttccaggtccggaggtttattactactactactacgatatggacgtctggggccaagggaccacggtcaccgtctcctca

SEQ ID NO: 266 - protein, 133 aa, Artificial Sequence
  Description of Artificial Sequence: Synthetic polypeptide
QVQLQQSGPGLVKPSQALSLTCAISGDSVSSNSAAWNWIRQSPSRGLEWLGRTYYRSKWYNDYAVSVKSRITINPDTSKNHFSLHLNSMTPEDTAVYYCARARIVVVPGPEVYYYYYYDMDVWGQGTTVTVSS

SEQ ID NO: 267 - DNA, 30 bp, Artificial Sequence
  Description of Artificial Sequence: Synthetic oligonucleotide
ggggacagtgtctccagcaacagtgctgct

SEQ ID NO: 268 - protein, 10 aa, Artificial Sequence
  Description of Artificial Sequence: Synthetic peptide
GDSVSSNSAA

SEQ ID NO: 269 - DNA, 27 bp, Artificial Sequence
  Description of Artificial Sequence: Synthetic oligonucleotide
acatattataggtccaagtggtataat

SEQ ID NO: 270 - protein, 9 aa, Artificial Sequence
  Description of Artificial Sequence: Synthetic peptide
TYYRSKWYN

SEQ ID NO: 271 - DNA, 69 bp, Artificial Sequence
  Description of Artificial Sequence: Synthetic oligonucleotide
gcaagggcgagaattgtagtcgttccaggtccggaggtttattactactactactacgatatggacgtc

SEQ ID NO: 272 - protein, 23 aa, Artificial Sequence
  Description of Artificial Sequence: Synthetic peptide
ARARIVVVPGPEVYYYYYYDMDV

SEQ ID NO: 273 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagaagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtagccctccgatcaccttcggccaagggacacgactggagattaaa

SEQ ID NO: 274 - protein, 108 aa, Artificial Sequence
  Description of Artificial Sequence: Synthetic polypeptide
DIQMTQSPSSLSASVGDRVTITCRASQSIRSYLNWYQQKPGKAPKLLIYAASSLQSGVPSRFSGSGSGTDFTLTISSLQPEDFATYYCQQSYSSPPITFGQGTRLEIK

SEQ ID NO: 275 - DNA, 18 bp, Artificial Sequence
  Description of Artificial Sequence: Synthetic oligonucleotide
cagagcattagaagctat

SEQ ID NO: 276 - protein, 6 aa, Artificial Sequence
  Description of Artificial Sequence: Synthetic peptide
QSIRSY

SEQ ID NO: 277 - DNA, 9 bp, Artificial Sequence
  Description of Artificial Sequence: Synthetic oligonucleotide
gctgcatcc

SEQ ID NO: 278 - protein, 3 aa, Artificial Sequence
  Description of Artificial Sequence: Synthetic peptide
AAS

SEQ ID NO: 279 - DNA, 30 bp, Artificial Sequence
  Description of Artificial Sequence: Synthetic oligonucleotide
caacagagttacagtagccctccgatcacc

SEQ ID NO: 280 - protein, 10 aa, Artificial Sequence
  Description of Artificial Sequence: Synthetic peptide
QQSYSSPPIT

SEQ ID NO: 281 - DNA, 399 bp, Artificial Sequence
  Description of Artificial Sequence: Synthetic polynucleotide
caggtacagctgcagcagtcaggtccaggactggtgaagccctcgcagaccctctcactcacctgtgtcatctccggggacagtgtctctactaatagtgctgcttggaactggatcaggcagtccccatcgagaggccttgagtggctgggaaggacatattataggtccaagtggtataatgattatgcagtatctgtgagaagtcgaataaccatcaacccagtcacatccaagaaccaggtcgccctgcatctgaactctgtgactcccgaggacacggctgtgtattactgtgcaagggcgggaattgttgtggtgccaggtccggaaacttattactattattatcacggtttggacgtctggggccaagggaccacggtcaccgtctcctca

SEQ ID NO: 282 - protein, 133 aa, Artificial Sequence
  Description of Artificial Sequence: Synthetic polypeptide
QVQLQQSGPGLVKPSQTLSLTCVISGDSVSTNSAAWNWIRQSPSRGLEWLGRTYYRSKWYNDYAVSVRSRITINPVTSKNQVALHLNSVTPEDTAVYYCARAGIVVVPGPETYYYYYHGLDVWGQGTTVTVSS

SEQ ID NO: 283 - DNA, 30 bp, Artificial Sequence
  Description of Artificial Sequence: Synthetic oligonucleotide
ggggacagtgtctctactaatagtgctgct

SEQ ID NO: 284 - protein, 10 aa, Artificial Sequence
  Description of Artificial Sequence: Synthetic peptide
GDSVSTNSAA

SEQ ID NO: 285 - DNA, 27 bp, Artificial Sequence
  Description of Artificial Sequence: Synthetic oligonucleotide
acatattataggtccaagtggtataat

SEQ ID NO: 286 - protein, 9 aa, Artificial Sequence
  Description of Artificial Sequence: Synthetic peptide
TYYRSKWYN

SEQ ID NO: 287 - DNA, 69 bp, Artificial Sequence
  Description of Artificial Sequence: Synthetic oligonucleotide
gcaagggcgggaattgttgtggtgccaggtccggaaacttattactattattatcacggtttggacgtc

SEQ ID NO: 288 - protein, 23 aa, Artificial Sequence
  Description of Artificial Sequence: Synthetic peptide
ARAGIVVVPGPETYYYYYHGLDV

SEQ ID NO: 289 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattagaagctatttaaattggtatcagcagaaaccagggaaagcccctaagctcctgatccatgttgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccacgggacacgactggaaattaaa

SEQ ID NO: 290 - protein, 108 aa, Artificial Sequence
  Description of Artificial Sequence: Synthetic polypeptide
DIQMTQSPSSLSASVGDRVTITCRASQNIRSYLNWYQQKPGKAPKLLIHVASSLQSGVPSRFSGSGSGTDFTLTISSLQPEDFATYYCQQSYSTPPITFGHGTRLEIK

SEQ ID NO: 291 - DNA, 18 bp, Artificial Sequence
  Description of Artificial Sequence: Synthetic oligonucleotide
cagaacattagaagctat

SEQ ID NO: 292 - protein, 6 aa, Artificial Sequence
  Description of Artificial Sequence: Synthetic peptide
QNIRSY

SEQ ID NO: 293 - DNA, 9 bp, Artificial Sequence
  Description of Artificial Sequence: Synthetic oligonucleotide
gttgcatcc

SEQ ID NO: 294 - protein, 3 aa, Artificial Sequence
  Description of Artificial Sequence: Synthetic peptide
VAS

SEQ ID NO: 295 - DNA, 30 bp, Artificial Sequence; identical to SEQ ID NO: 15
  Description of Artificial Sequence: Synthetic oligonucleotide

SEQ ID NO: 296 - protein, 10 aa, Artificial Sequence
  Description of Artificial Sequence: Synthetic peptide
QQSYSTPPIT

SEQ ID NO: 297 - DNA, 348 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccctcagcagtaatagttactactggggctggatccgccagcccccagggaaggggctggagtggattgggagtatctattatagtgggagcacctactacaacccgtccctcaagagtcgagtcaccatatccgtagacacgtcccagaaccagttctccctgaagctgagctctgtgaccgccgcagacacggctgtgtattactgtgcgagacagaactactttgactactggggccagggaaccctggtcaccgtctcctca

SEQ ID NO: 298 - protein, 116 aa, Artificial Sequence
  Description of Artificial Sequence: Synthetic polypeptide
QLQLQESGPGLVKPSETLSLTCTVSGGSLSSNSYYWGWIRQPPGKGLEWIGSIYYSGSTYYNPSLKSRVTISVDTSQNQFSLKLSSVTAADTAVYYCARQNYFDYWGQGTLVTVSS

SEQ ID NO: 299 - DNA, 30 bp, Artificial Sequence
  Description of Artificial Sequence: Synthetic oligonucleotide
ggtggctccctcagcagtaatagttactac

SEQ ID NO: 300 - protein, 10 aa, Artificial Sequence
  Description of Artificial Sequence: Synthetic peptide
GGSLSSNSYY

SEQ ID NO: 301 - DNA, 21 bp, Artificial Sequence
  Description of Artificial Sequence: Synthetic oligonucleotide
atctattatagtgggagcacc

SEQ ID NO: 302 - protein, 7 aa, Artificial Sequence
  Description of Artificial Sequence: Synthetic peptide
IYYSGST

SEQ ID NO: 303 - DNA, 24 bp, Artificial Sequence
  Description of Artificial Sequence: Synthetic oligonucleotide
gcgagacagaactactttgactac

SEQ ID NO: 304 - protein, 8 aa, Artificial Sequence
  Description of Artificial Sequence: Synthetic peptide
ARQNYFDY

SEQ ID NO: 305 - DNA, 321 bp, Artificial Sequence
  Description of Artificial Sequence: Synthetic polynucleotide
gacatccagttgacccagtctccatccttcctgtctgcatctgtaggagacagagtcaccatcacttgctgggccagtcagggcattagcaggtatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttatcctctcactttcggccctgggaccaaactggatatcaaa

SEQ ID NO: 306 - protein, 107 aa, Artificial Sequence
  Description of Artificial Sequence: Synthetic polypeptide
DIQLTQSPSFLSASVGDRVTITCWASQGISRYLAWYQQKPGKAPKLLIYAASTLQSGVPSRFSGSGSGTEFTLTISSLQPEDFATYYCQQLNSYPLTFGPGTKLDIK

SEQ ID NO: 307 - DNA, 18 bp, Artificial Sequence
  Description of Artificial Sequence: Synthetic oligonucleotide
cagggcattagcaggtat

SEQ ID NO: 308 - protein, 6 aa, Artificial Sequence
  Description of Artificial Sequence: Synthetic peptide
QGISRY

SEQ ID NO: 309 - DNA, 9 bp, Artificial Sequence
  Description of Artificial Sequence: Synthetic oligonucleotide
gctgcatcc

SEQ ID NO: 310 - protein, 3 aa, Artificial Sequence
  Description of Artificial Sequence: Synthetic peptide
AAS

SEQ ID NO: 311 - DNA, 27 bp, Artificial Sequence
  Description of Artificial Sequence: Synthetic oligonucleotide
caacagcttaatagttatcctctcact

SEQ ID NO: 312 - protein, 9 aa, Artificial Sequence
  Description of Artificial Sequence: Synthetic peptide
QQLNSYPLT

SEQ ID NO: 313 - DNA, 345 bp, Artificial Sequence
  Description of Artificial Sequence: Synthetic polynucleotide
caggtgcagctggtggagtctgggggaggcgtggtccagcctgggaggtccctgagactctcctgtgcagtctctggattcacctccagtacctatggcatgaactgggtccgccaggctccaggcaaggggctggagtgggtggcagttatatcatatgatggaagtaataaatactacgcagactccgtgaagggccgattcaccatctccagggacaattccaagaacacgctgtatctgcaaatgaacagcctgagacctgaggacacggctgtgtattactgtgcgagaggaaggtacttcgatctctggggccgtggcaccctggtcactgtctcctca

SEQ ID NO: 314 - protein, 115 aa, Artificial Sequence
  Description of Artificial Sequence: Synthetic polypeptide
QVQLVESGGGVVQPGRSLRLSCAVSGFTSSTYGMNWVRQAPGKGLEWVAVISYDGSNKYYADSVKGRFTISRDNSKNTLYLQMNSLRPEDTAVYYCARGRYFDLWGRGTLVTVSS

SEQ ID NO: 315 - DNA, 24 bp, Artificial Sequence
  Description of Artificial Sequence: Synthetic oligonucleotide
ggattcacctccagtacctatggc

SEQ ID NO: 316 - protein, 8 aa, Artificial Sequence
  Description of Artificial Sequence: Synthetic peptide
GFTSSTYG

SEQ ID NO: 317 - DNA, 24 bp, Artificial Sequence
  Description of Artificial Sequence: Synthetic oligonucleotide
atatcatatgatggaagtaataaa

SEQ ID NO: 318 - protein, 8 aa, Artificial Sequence
  Description of Artificial Sequence: Synthetic peptide
ISYDGSNK

SEQ ID NO: 319 - DNA, 24 bp, Artificial Sequence
  Description of Artificial Sequence: Synthetic oligonucleotide
gcgagaggaaggtacttcgatctc

SEQ ID NO: 320 - protein, 8 aa, Artificial Sequence
  Description of Artificial Sequence: Synthetic peptide
ARGRYFDL

SEQ ID NO: 321 - DNA, 321 bp, Artificial Sequence
  Description of Artificial Sequence: Synthetic polynucleotide
gacatccagatgacccagtctccttccaccctgtctgcatctgtaggagacagagtcaccatcacttgccgggccagtcaaattattagtagctggttggcctggtatcagcagaaaccagggaaagcccctaaactcctgatctataaggcgtctagtttagcaagtggggtcccatcaaggttcagcggcagtggatctgggacagaattcactctcaccatcagcagcctgcagcctgatgattttgcaacttattactgccaacagtataaaagttattcttacacctttggccaggggaccaacctggagatcaaa

SEQ ID NO: 322 - protein, 107 aa, Artificial Sequence
  Description of Artificial Sequence: Synthetic polypeptide
DIQMTQSPSTLSASVGDRVTITCRASQIISSWLAWYQQKPGKAPKLLIYKASSLASGVPSRFSGSGSGTEFTLTISSLQPDDFATYYCQQYKSYSYTFGQGTNLEIK

SEQ ID NO: 323 - DNA, 18 bp, Artificial Sequence
  Description of Artificial Sequence: Synthetic oligonucleotide
caaattattagtagctgg

SEQ ID NO: 324 - protein, 6 aa, Artificial Sequence
  Description of Artificial Sequence: Synthetic peptide
QIISSW

SEQ ID NO: 325 - DNA, 9 bp, Artificial Sequence
  Description of Artificial Sequence: Synthetic oligonucleotide
aaggcgtct

SEQ ID NO: 326 - protein, 3 aa, Artificial Sequence
  Description of Artificial Sequence: Synthetic peptide
KAS

SEQ ID NO: 327 - DNA, 27 bp, Artificial Sequence
  Description of Artificial Sequence: Synthetic oligonucleotide
caacagtataaaagttattcttacacc

SEQ ID NO: 328 - protein, 9 aa, Artificial Sequence
  Description of Artificial Sequence: Synthetic peptide
QQYKSYSYT

SEQ ID NO: 329 - DNA, 378 bp, Artificial Sequence
  Description of Artificial Sequence: Synthetic polynucleotide
caggtgcagctggtggagtctgggggaggcgtggtccagcctgggaggtccctgggactctcctgtgcagcgtctggattcaccttcagtagctatggcatgcactgggtccgccaggctccaggcaaggggctggagtgggtggcagttatatggtatgatggaagtaataaatactatgtagactccgtgaagggccgattcaccatctccagagacaattccaagaacacgctgtatctgcaaatgaacagcctgagagccgaggacacggctgtgtattactgtgcgagagaggggctacgatttttggagaattactactactactacggtatggacgtctggggccaagggaccacggtcaccgtctcctca

SEQ ID NO: 330 - protein, 126 aa, Artificial Sequence
  Description of Artificial Sequence: Synthetic polypeptide
QVQLVESGGGVVQPGRSLGLSCAASGFTFSSYGMHWVRQAPGKGLEWVAVIWYDGSNKYYVDSVKGRFTISRDNSKNTLYLQMNSLRAEDTAVYYCAREGLRFLENYYYYYGMDVWGQGTTVTVSS

SEQ ID NO: 331 - DNA, 24 bp, Artificial Sequence
  Description of Artificial Sequence: Synthetic oligonucleotide
ggattcaccttcagtagctatggc

SEQ ID NO: 332 - protein, 8 aa, Artificial Sequence
  Description of Artificial Sequence: Synthetic peptide
GFTFSSYG

SEQ ID NO: 333 - DNA, 24 bp, Artificial Sequence
  Description of Artificial Sequence: Synthetic oligonucleotide
atatggtatgatggaagtaataaa

SEQ ID NO: 334 - protein, 8 aa, Artificial Sequence
  Description of Artificial Sequence: Synthetic peptide
IWYDGSNK

SEQ ID NO: 335 - DNA, 57 bp, Artificial Sequence
  Description of Artificial Sequence: Synthetic oligonucleotide
gcgagagaggggctacgatttttggagaattactactactactacggtatggacgtc

SEQ ID NO: 336 - protein, 19 aa, Artificial Sequence
  Description of Artificial Sequence: Synthetic peptide
AREGLRFLENYYYYYGMDV

SEQ ID NO: 337 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagcagcacctacttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtacctcaccgtacacttttggccaggggaccaagctggagatcaaa

SEQ ID NO: 338 - protein, 108 aa, Artificial Sequence
  Description of Artificial Sequence: Synthetic polypeptide
EIVLTQSPGTLSLSPGERATLSCRASQSISSTYLAWYQQRPGQAPRLLIYGASSRATGIPDRFSGSGSGTDFTLTISRLEPEDFAVYYCQQYGTSPYTFGQGTKLEIK

SEQ ID NO: 339 - DNA, 21 bp, Artificial Sequence
  Description of Artificial Sequence: Synthetic oligonucleotide
cagagtattagcagcacctac

SEQ ID NO: 340 - protein, 7 aa, Artificial Sequence
  Description of Artificial Sequence: Synthetic peptide
QSISSTY

SEQ ID NO: 341 - DNA, 9 bp, Artificial Sequence
  Description of Artificial Sequence: Synthetic oligonucleotide
ggtgcatcc

SEQ ID NO: 342 - protein, 3 aa, Artificial Sequence
  Description of Artificial Sequence: Synthetic peptide
GAS

SEQ ID NO: 343 - DNA, 27 bp, Artificial Sequence
  Description of Artificial Sequence: Synthetic oligonucleotide
cagcagtatggtacctcaccgtacact

SEQ ID NO: 344 - protein, 9 aa, Artificial Sequence
  Description of Artificial Sequence: Synthetic peptide
QQYGTSPYT

SEQ ID NO: 345 - DNA, 345 bp, Artificial Sequence; identical to SEQ ID NO: 313
  Description of Artificial Sequence: Synthetic polynucleotide

SEQ ID NO: 346 - protein, 115 aa, Artificial Sequence; identical to SEQ ID NO: 314
  Description of Artificial Sequence: Synthetic polypeptide

SEQ ID NO: 347 - DNA, 24 bp, Artificial Sequence
  Description of Artificial Sequence: Synthetic oligonucleotide
ggattcacctccagtacctatggc

SEQ ID NO: 348 - protein, 8 aa, Artificial Sequence
  Description of Artificial Sequence: Synthetic peptide
GFTSSTYG

SEQ ID NO: 349 - DNA, 24 bp, Artificial Sequence
  Description of Artificial Sequence: Synthetic oligonucleotide
atatcatatgatggaagtaataaa

SEQ ID NO: 350 - protein, 8 aa, Artificial Sequence
  Description of Artificial Sequence: Synthetic peptide
ISYDGSNK

SEQ ID NO: 351 - DNA, 24 bp, Artificial Sequence
  Description of Artificial Sequence: Synthetic oligonucleotide
gcgagaggaaggtacttcgatctc

SEQ ID NO: 352 - protein, 8 aa, Artificial Sequence
  Description of Artificial Sequence: Synthetic peptide
ARGRYFDL

SEQ ID NO: 353 - DNA, 321 bp, Artificial Sequence
  Description of Artificial Sequence: Synthetic polynucleotide
gacatccagatgacccagtctccttccaccctgtctgcatctgtaggagacagagtcaccatcacttgccgggccagtcaaattattagtagctggttggcctggtatcagcagaaaccagggaaagcccctaaactcctgatctataaggcgtctagtttagcaagtggggtcccatcaaggttcagcggcagtggatctgggacagaattcactctcaccatcagcagcctgcagcctgatgattttgcaacttattactgccaacagtataaaagttattcttacacctttggccaggggaccaagctggagatcaaa

SEQ ID NO: 354 - protein, 107 aa, Artificial Sequence
  Description of Artificial Sequence: Synthetic polypeptide
DIQMTQSPSTLSASVGDRVTITCRASQIISSWLAWYQQKPGKAPKLLIYKASSLASGVPSRFSGSGSGTEFTLTISSLQPDDFATYYCQQYKSYSYTFGQGTKLEIK

SEQ ID NO: 355 - DNA, 18 bp, Artificial Sequence
  Description of Artificial Sequence: Synthetic oligonucleotide
caaattattagtagctgg

SEQ ID NO: 356 - protein, 6 aa, Artificial Sequence
  Description of Artificial Sequence: Synthetic peptide
QIISSW

SEQ ID NO: 357 - DNA, 9 bp, Artificial Sequence
  Description of Artificial Sequence: Synthetic oligonucleotide
aaggcgtct

SEQ ID NO: 358 - protein, 3 aa, Artificial Sequence
  Description of Artificial Sequence: Synthetic peptide
KAS

SEQ ID NO: 359 - DNA, 27 bp, Artificial Sequence
  Description of Artificial Sequence: Synthetic oligonucleotide
caacagtataaaagttattcttacacc

SEQ ID NO: 360 - protein, 9 aa, Artificial Sequence
  Description of Artificial Sequence: Synthetic peptide
QQYKSYSYT

SEQ ID NO: 361 - DNA, 345 bp, Artificial Sequence
  Description of Artificial Sequence: Synthetic polynucleotide
caggtgcagctggtggagtctgggggaggcgtggtccagcctgggaggtccctgagactctcctgtgcagtctctggattcacctccagtacctatggcatgaactgggtccgccaggctccaggcaaggggctggagtgggtggcagttatatcatttgatggaagtaataaatactacgcagactccgtgaagggccgattcaccatctccagggacaattccaagaacacgctgtatctgcaaatgagcagcctgagacctgaggacacggctgtgtattactgtgcgagaggaaggtacttcgatctctggggccgtggcaccctggtcactgtctcctca

SEQ ID NO: 362 - protein, 115 aa, Artificial Sequence
  Description of Artificial Sequence: Synthetic polypeptide
QVQLVESGGGVVQPGRSLRLSCAVSGFTSSTYGMNWVRQAPGKGLEWVAVISFDGSNKYYADSVKGRFTISRDNSKNTLYLQMSSLRPEDTAVYYCARGRYFDLWGRGTLVTVSS

SEQ ID NO: 363 - DNA, 24 bp, Artificial Sequence
  Description of Artificial Sequence: Synthetic oligonucleotide
ggattcacctccagtacctatggc

SEQ ID NO: 364 - protein, 8 aa, Artificial Sequence
  Description of Artificial Sequence: Synthetic peptide
GFTSSTYG

SEQ ID NO: 365 - DNA, 24 bp, Artificial Sequence
  Description of Artificial Sequence: Synthetic oligonucleotide
atatcatttgatggaagtaataaa

SEQ ID NO: 366 - protein, 8 aa, Artificial Sequence
  Description of Artificial Sequence: Synthetic peptide
ISFDGSNK

SEQ ID NO: 367 - DNA, 24 bp, Artificial Sequence
  Description of Artificial Sequence: Synthetic oligonucleotide
gcgagaggaaggtacttcgatctc

SEQ ID NO: 368 - protein, 8 aa, Artificial Sequence
  Description of Artificial Sequence: Synthetic peptide
ARGRYFDL

SEQ ID NO: 369 - DNA, 321 bp, Artificial Sequence
  Description of Artificial Sequence: Synthetic polynucleotide
gacacccagatgacccagtctccttccaccctgtctgcatctgtaggagacagagtcaccatcacttgccgggccagtcaaattattagtagctggttggcctggtatcagcagaaaccagggaaagcccctaaactcctgatctataaggcgtctagtttagcaagtggggtcccatcaaggttcagcggcagtggatctgggacagaattcactctcaccatcagcagcctgcagcctgatgattttgcaacttattactgccaacagtataaaagttattcttacacctttggccaggggaccaacctggagatcaaa

SEQ ID NO: 370 - protein, 107 aa, Artificial Sequence
  Description of Artificial Sequence: Synthetic polypeptide
DTQMTQSPSTLSASVGDRVTITCRASQIISSWLAWYQQKPGKAPKLLIYKASSLASGVPSRFSGSGSGTEFTLTISSLQPDDFATYYCQQYKSYSYTFGQGTNLEIK

SEQ ID NO: 371 - DNA, 18 bp, Artificial Sequence
  Description of Artificial Sequence: Synthetic oligonucleotide
caaattattagtagctgg

SEQ ID NO: 372 - protein, 6 aa, Artificial Sequence
  Description of Artificial Sequence: Synthetic peptide
QIISSW

SEQ ID NO: 373 - DNA, 9 bp, Artificial Sequence
  Description of Artificial Sequence: Synthetic oligonucleotide
aaggcgtct

SEQ ID NO: 374 - protein, 3 aa, Artificial Sequence
  Description of Artificial Sequence: Synthetic peptide
KAS

SEQ ID NO: 375 - DNA, 27 bp, Artificial Sequence
  Description of Artificial Sequence: Synthetic oligonucleotide
caacagtataaaagttattcttacacc

SEQ ID NO: 376 - protein, 9 aa, Artificial Sequence
  Description of Artificial Sequence: Synthetic peptide
QQYKSYSYT

SEQ ID NO: 377 - DNA, 345 bp, Artificial Sequence; identical to SEQ ID NO: 361
  Description of Artificial Sequence: Synthetic polynucleotide

SEQ ID NO: 378 - protein, 115 aa, Artificial Sequence; identical to SEQ ID NO: 362
  Description of Artificial Sequence: Synthetic polypeptide

SEQ ID NO: 379 - DNA, 24 bp, Artificial Sequence
  Description of Artificial Sequence: Synthetic oligonucleotide
ggattcacctccagtacctatggc

SEQ ID NO: 380 - protein, 8 aa, Artificial Sequence
  Description of Artificial Sequence: Synthetic peptide
GFTSSTYG

SEQ ID NO: 381 - DNA, 24 bp, Artificial Sequence
  Description of Artificial Sequence: Synthetic oligonucleotide
atatcatttgatggaagtaataaa

SEQ ID NO: 382 - protein, 8 aa, Artificial Sequence
  Description of Artificial Sequence: Synthetic peptide
ISFDGSNK

SEQ ID NO: 383 - DNA, 24 bp, Artificial Sequence
  Description of Artificial Sequence: Synthetic oligonucleotide
gcgagaggaaggtacttcgatctc

SEQ ID NO: 384 - protein, 8 aa, Artificial Sequence
  Description of Artificial Sequence: Synthetic peptide
ARGRYFDL

SEQ ID NO: 385 - DNA, 321 bp, Artificial Sequence; identical to SEQ ID NO: 369
  Description of Artificial Sequence: Synthetic polynucleotide

SEQ ID NO: 386 - protein, 107 aa, Artificial Sequence; identical to SEQ ID NO: 370
  Description of Artificial Sequence: Synthetic polypeptide

SEQ ID NO: 387 - DNA, 18 bp, Artificial Sequence
  Description of Artificial Sequence: Synthetic oligonucleotide
caaattattagtagctgg

SEQ ID NO: 388 - protein, 6 aa, Artificial Sequence
  Description of Artificial Sequence: Synthetic peptide
QIISSW

SEQ ID NO: 389 - DNA, 9 bp, Artificial Sequence
  Description of Artificial Sequence: Synthetic oligonucleotide
aaggcgtct

SEQ ID NO: 390 - protein, 3 aa, Artificial Sequence
  Description of Artificial Sequence: Synthetic peptide
KAS

SEQ ID NO: 391 - DNA, 27 bp, Artificial Sequence
  Description of Artificial Sequence: Synthetic oligonucleotide
caacagtataaaagttattcttacacc

SEQ ID NO: 392 - protein, 9 aa, Artificial Sequence
  Description of Artificial Sequence: Synthetic peptide
QQYKSYSYT

SEQ ID NO: 393-400 - skipped (8 entries)

SEQ ID NO: 401 - DNA, 369 bp, Artificial Sequence
  Description of Artificial Sequence: Synthetic polynucleotide
gaagtgcaactggtggagtctgggggaggcttagtacagcctggcgggtccctgagactctcctgtgcagccactggattcacctttgatgattttaccatgcactgggtccggcaagctccagggaagggcctggagtgggtctcaggtatcagttggaatagtggtagcataggctatgtggactctgtgaagggccgattcaccatctccagagacaacgccaagaactccctgtatctgcaaatgaacagtctgagagctgaggacacggccttgtactactgtgcaaaagataatagtggctacggctattattactacggtatggacgtctggggccaagggaccacggtcaccgtctcctca

SEQ ID NO: 402 - protein, 123 aa, Artificial Sequence
  Description of Artificial Sequence: Synthetic polypeptide
EVQLVESGGGLVQPGGSLRLSCAATGFTFDDFTMHWVRQAPGKGLEWVSGISWNSGSIGYVDSVKGRFTISRDNAKNSLYLQMNSLRAEDTALYYCAKDNSGYGYYYYGMDVWGQGTTVTVSS

SEQ ID NO: 403 - DNA, 24 bp, Artificial Sequence
  Description of Artificial Sequence: Synthetic oligonucleotide
ggattcacctttgatgattttacc

SEQ ID NO: 404 - protein, 8 aa, Artificial Sequence
  Description of Artificial Sequence: Synthetic peptide
GFTFDDFT

SEQ ID NO: 405 - DNA, 24 bp, Artificial Sequence
  Description of Artificial Sequence: Synthetic oligonucleotide
atcagttggaatagtggtagcata

SEQ ID NO: 406 - protein, 8 aa, Artificial Sequence
  Description of Artificial Sequence: Synthetic peptide
ISWNSGSI

SEQ ID NO: 407 - DNA, 48 bp, Artificial Sequence
  Description of Artificial Sequence: Synthetic oligonucleotide
gcaaaagataatagtggctacggctattattactacggtatggacgtc

SEQ ID NO: 408 - protein, 16 aa, Artificial Sequence
  Description of Artificial Sequence: Synthetic peptide
AKDNSGYGYYYYGMDV

SEQ ID NO: 409 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcacagtgttagcaggaactcagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcaatttattactgtcagcagtataataattggcctctcactttcggcggagggaccaaggtggagatcaaa

SEQ ID NO: 410 - protein, 107 aa, Artificial Sequence
  Description of Artificial Sequence: Synthetic polypeptide
EIVMTQSPATLSVSPGERATLSCRASHSVSRNSAWYQQKPGQAPRLLIYGASTRATGIPARFSGSGSGTEFTLTISSLQSEDFAIYYCQQYNNWPLTFGGGTKVEIK

SEQ ID NO: 411 - DNA, 18 bp, Artificial Sequence
  Description of Artificial Sequence: Synthetic oligonucleotide
cacagtgttagcaggaac

SEQ ID NO: 412 - protein, 6 aa, Artificial Sequence
  Description of Artificial Sequence: Synthetic peptide
HSVSRN

SEQ ID NO: 413 - DNA, 9 bp, Artificial Sequence
  Description of Artificial Sequence: Synthetic oligonucleotide
ggtgcatcc

SEQ ID NO: 414 - protein, 3 aa, Artificial Sequence
  Description of Artificial Sequence: Synthetic peptide
GAS

SEQ ID NO: 415 - DNA, 27 bp, Artificial Sequence
  Description of Artificial Sequence: Synthetic oligonucleotide
cagcagtataataattggcctctcact

SEQ ID NO: 416 - protein, 9 aa, Artificial Sequence
  Description of Artificial Sequence: Synthetic peptide
QQYNNWPLT

SEQ ID NO: 417 - DNA, 372 bp, Artificial Sequence
  Description of Artificial Sequence: Synthetic polynucleotide
gaagtgcaactggtggaatcggggggaggcttggtacagcctggcgggtccctgagactctcctgtgcagcctctggattctcctttgatgattataccatgcactgggtccggcaacctccagggaagggcctggagtgggtctcaggtattagttggaatagtggtagcataggctatgcggactctgtgaagggccgattcaccatctccagagacaacgccaagaactccctgtatctgcaaatgaacagtctgagagctggggacacggccttgtactactgtgcaaaagataatagtggctacggctattactactactacggtatggacgtctggggccaagggaccacggtcaccgtctcctca

SEQ ID NO: 418 - protein, 124 aa, Artificial Sequence
  Description of Artificial Sequence: Synthetic polypeptide
EVQLVESGGGLVQPGGSLRLSCAASGFSFDDYTMHWVRQPPGKGLEWVSGISWNSGSIGYADSVKGRFTISRDNAKNSLYLQMNSLRAGDTALYYCAKDNSGYGYYYYYGMDVWGQGTTVTVSS

SEQ ID NO: 419 - DNA, 24 bp, Artificial Sequence
  Description of Artificial Sequence: Synthetic oligonucleotide
ggattctcctttgatgattatacc

SEQ ID NO: 420 - protein, 8 aa, Artificial Sequence
  Description of Artificial Sequence: Synthetic peptide
GFSFDDYT

SEQ ID NO: 421 - DNA, 24 bp, Artificial Sequence
  Description of Artificial Sequence: Synthetic oligonucleotide
attagttggaatagtggtagcata

SEQ ID NO: 422 - protein, 8 aa, Artificial Sequence
  Description of Artificial Sequence: Synthetic peptide
ISWNSGSI

SEQ ID NO: 423 - DNA, 51 bp, Artificial Sequence
  Description of Artificial Sequence: Synthetic oligonucleotide
gcaaaagataatagtggctacggctattactactactacggtatggacgtc

SEQ ID NO: 424 - protein, 17 aa, Artificial Sequence
  Description of Artificial Sequence: Synthetic peptide
AKDNSGYGYYYYYGMDV

SEQ ID NO: 425 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccagactcctcatctatggtgcatccaccagggccactggtatcccagccaggttcagtggcagtgggtctgggacagaattcactctcaccatcagcagcctgcagtctgaagattttgcagtttattactgtcagcagtattataactggcctctcactttcggcggagggaccaaggtggagatcaaa

SEQ ID NO: 426 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYYNWPLTFGGGTKVEIK

SEQ ID NO: 427 - DNA, 18 bp, Artificial Sequence
  Description of Artificial Sequence: Synthetic oligonucleotide
cagagtgttagcagcaac

SEQ ID NO: 428 - protein, 6 aa, Artificial Sequence
  Description of Artificial Sequence: Synthetic peptide
QSVSSN

SEQ ID NO: 429 - DNA, 9 bp, Artificial Sequence
  Description of Artificial Sequence: Synthetic oligonucleotide
ggtgcatcc

SEQ ID NO: 430 - protein, 3 aa, Artificial Sequence
  Description of Artificial Sequence: Synthetic peptide
GAS

SEQ ID NO: 431 - DNA, 27 bp, Artificial Sequence
  Description of Artificial Sequence: Synthetic oligonucleotide
cagcagtattataactggcctctcact

SEQ ID NO: 432 - protein, 9 aa, Artificial Sequence
  Description of Artificial Sequence: Synthetic peptide
QQYYNWPLT

SEQ ID NO: 433 - DNA, 372 bp, Artificial Sequence
  Description of Artificial Sequence: Synthetic polynucleotide
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcaaaggctatgcggactctgtgaagggccgattcaccatctccagagacaatgccaagaactccctgtatctgcaaatgaacagtctgagaactgaggacacggccttctattactgtgcaaaagatatgagtggctacgcccactacttctactacggtatggacgtctggggccaagggaccacggtcaccgtctcctca

SEQ ID NO: 434 - protein, 124 aa, Artificial Sequence
  Description of Artificial Sequence: Synthetic polypeptide
EVQLVESGGGLVQPGRSLRLSCVASGFPFADYTMHWVRQAPGKGLEWVSDISWNSGSKGYADSVKGRFTISRDNAKNSLYLQMNSLRTEDTAFYYCAKDMSGYAHYFYYGMDVWGQGTTVTVSS

SEQ ID NO: 435 - DNA, 24 bp, Artificial Sequence
  Description of Artificial Sequence: Synthetic oligonucleotide
ggattcccctttgctgattatacc

SEQ ID NO: 436 - protein, 8 aa, Artificial Sequence
  Description of Artificial Sequence: Synthetic peptide
GFPFADYT

SEQ ID NO: 437 - DNA, 24 bp, Artificial Sequence
  Description of Artificial Sequence: Synthetic oligonucleotide
attagttggaatagtggtagcaaa

SEQ ID NO: 438 - protein, 8 aa, Artificial Sequence
  Description of Artificial Sequence: Synthetic peptide
ISWNSGSK

SEQ ID NO: 439 - DNA, 51 bp, Artificial Sequence
  Description of Artificial Sequence: Synthetic oligonucleotide
gcaaaagatatgagtggctacgcccactacttctactacggtatggacgtc

SEQ ID NO: 440 - protein, 17 aa, Artificial Sequence
  Description of Artificial Sequence: Synthetic peptide
AKDMSGYAHYFYYGMDV

SEQ ID NO: 441 - DNA, 324 bp, Artificial Sequence
  Description of Artificial Sequence: Synthetic polynucleotide
gacatccagatgacccagtctccatcctccctgtctgcatctgtaggagacagagtcaccatcacttgccggccaagtcagagcattagcagctatttaaattggtttcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 442 - protein, 108 aa, Artificial Sequence
  Description of Artificial Sequence: Synthetic polypeptide
DIQMTQSPSSLSASVGDRVTITCRPSQSISSYLNWFQQKPGKAPKLLIYAASSLQSGVPSRFSGSGSGTDFTLTISSLQPEDFATYYCQQSYSTPPITFGQGTRLEIK

SEQ ID NO: 443 - DNA, 18 bp, Artificial Sequence
  Description of Artificial Sequence: Synthetic oligonucleotide
cagagcattagcagctat

SEQ ID NO: 444 - protein, 6 aa, Artificial Sequence
  Description of Artificial Sequence: Synthetic peptide
QSISSY

SEQ ID NO: 445 - DNA, 9 bp, Artificial Sequence
  Description of Artificial Sequence: Synthetic oligonucleotide
gctgcatcc

SEQ ID NO: 446 - protein, 3 aa, Artificial Sequence
  Description of Artificial Sequence: Synthetic peptide
AAS

SEQ ID NO: 447 - DNA, 30 bp, Artificial Sequence; identical to SEQ ID NO: 15
  Description of Artificial Sequence: Synthetic oligonucleotide

SEQ ID NO: 448 - protein, 10 aa, Artificial Sequence
  Description of Artificial Sequence: Synthetic peptide
QQSYSTPPIT

SEQ ID NO: 449 - DNA, 372 bp, Artificial Sequence
  Description of Artificial Sequence: Synthetic polynucleotide
gaagtacaactggtggagtctgggggaggcttggtacagcctggcaggtccctaagactctcctgtgcagcctctggattcacctttgatgattataccatgcactgggtccggcaagttccagggaagggcctggagtgggtctcaggtattagttggaatagtggcagcttggcctacgcggactctgtgaagggccgattcaccatctccagagacaacgccaagaattccctgtatctgcaaatgaacagtcttcaccctgaggacacggccctctattactgtgtaaaagatggtagtggctacggccactactcctactacggtttggacgtctggggccaggggaccacggtcaccgtctcctca

SEQ ID NO: 450 - protein, 124 aa, Artificial Sequence
  Description of Artificial Sequence: Synthetic polypeptide
EVQLVESGGGLVQPGRSLRLSCAASGFTFDDYTMHWVRQVPGKGLEWVSGISWNSGSLAYADSVKGRFTISRDNAKNSLYLQMNSLHPEDTALYYCVKDGSGYGHYSYYGLDVWGQGTTVTVSS

SEQ ID NO: 451 - DNA, 24 bp, Artificial Sequence
  Description of Artificial Sequence: Synthetic oligonucleotide
ggattcacctttgatgattatacc

SEQ ID NO: 452 - protein, 8 aa, Artificial Sequence
  Description of Artificial Sequence: Synthetic peptide
GFTFDDYT

SEQ ID NO: 453 - DNA, 24 bp, Artificial Sequence
  Description of Artificial Sequence: Synthetic oligonucleotide
attagttggaatagtggcagcttg

SEQ ID NO: 454 - protein, 8 aa, Artificial Sequence
  Description of Artificial Sequence: Synthetic peptide
ISWNSGSL

SEQ ID NO: 455 - DNA, 51 bp, Artificial Sequence
  Description of Artificial Sequence: Synthetic oligonucleotide
gtaaaagatggtagtggctacggccactactcctactacggtttggacgtc

SEQ ID NO: 456 - protein, 17 aa, Artificial Sequence
  Description of Artificial Sequence: Synthetic peptide
VKDGSGYGHYSYYGLDV

SEQ ID NO: 457 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagttcaccttggacgttcggccaagggaccaaggtggaaatcaaa

SEQ ID NO: 458 - protein, 108 aa, Artificial Sequence; identical to SEQ ID NO: 114
  Description of Artificial Sequence: Synthetic polypeptide

SEQ ID NO: 459 - DNA, 21 bp, Artificial Sequence
  Description of Artificial Sequence: Synthetic oligonucleotide
cagagtgttagcagcagctac

SEQ ID NO: 460 - protein, 7 aa, Artificial Sequence
  Description of Artificial Sequence: Synthetic peptide
QSVSSSY

SEQ ID NO: 461 - DNA, 9 bp, Artificial Sequence
  Description of Artificial Sequence: Synthetic oligonucleotide
ggtgcatcc

SEQ ID NO: 462 - protein, 3 aa, Artificial Sequence
  Description of Artificial Sequence: Synthetic peptide
GAS

SEQ ID NO: 463 - DNA, 27 bp, Artificial Sequence
  Description of Artificial Sequence: Synthetic oligonucleotide
cagcagtatggtagttcaccttggacg

SEQ ID NO: 464 - protein, 9 aa, Artificial Sequence
  Description of Artificial Sequence: Synthetic peptide
QQYGSSPWT

SEQ ID NO: 465 - DNA, 372 bp, Artificial Sequence
  Description of Artificial Sequence: Synthetic polynucleotide
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcataggctatgcggactctgtgaagggccgattcaccatctccagagacaatgccaagaactccctgtatctgcaaatgaacagtctgagaactgaggacacggccttgtattactgtgcaaaagatatgagtggctacgcccactacttctactacggtatggacgtctggggccaagggaccacggtcaccgtctcctca

SEQ ID NO: 466 - protein, 124 aa, Artificial Sequence
  Description of Artificial Sequence: Synthetic polypeptide
EVQLVESGGGLVQPGRSLRLSCVASGFPFADYTMHWVRQAPGKGLEWVSDISWNSGSIGYADSVKGRFTISRDNAKNSLYLQMNSLRTEDTALYYCAKDMSGYAHYFYYGMDVWGQGTTVTVSS

SEQ ID NO: 467 - DNA, 24 bp, Artificial Sequence
  Description of Artificial Sequence: Synthetic oligonucleotide
ggattcccctttgctgattatacc

SEQ ID NO: 468 - protein, 8 aa, Artificial Sequence
  Description of Artificial Sequence: Synthetic peptide
GFPFADYT

SEQ ID NO: 469 - DNA, 24 bp, Artificial Sequence
  Description of Artificial Sequence: Synthetic oligonucleotide
attagttggaatagtggtagcata

SEQ ID NO: 470 - protein, 8 aa, Artificial Sequence
  Description of Artificial Sequence: Synthetic peptide
ISWNSGSI

SEQ ID NO: 471 - DNA, 51 bp, Artificial Sequence; identical to SEQ ID NO: 439
  Description of Artificial Sequence: Synthetic oligonucleotide

SEQ ID NO: 472 - protein, 17 aa, Artificial Sequence
  Description of Artificial Sequence: Synthetic peptide
AKDMSGYAHYFYYGMDV

SEQ ID NO: 473 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 474 - protein, 108 aa, Artificial Sequence
  Description of Artificial Sequence: Synthetic polypeptide
DIQMTQSPSSLSASVGDRVTITCRASQSISSYLNWYQQKPGKAPKLLIFAASSLQSGVPSRFSGSGSGTDFTLTISSLQPEDFATYYCQQSYSTPPITFGQGTRLEIK

SEQ ID NO: 475 - DNA, 18 bp, Artificial Sequence
  Description of Artificial Sequence: Synthetic oligonucleotide
cagagcattagcagctat

SEQ ID NO: 476 - protein, 6 aa, Artificial Sequence
  Description of Artificial Sequence: Synthetic peptide
QSISSY

SEQ ID NO: 477 - DNA, 9 bp, Artificial Sequence
  Description of Artificial Sequence: Synthetic oligonucleotide
gctgcatcc

SEQ ID NO: 478 - protein, 3 aa, Artificial Sequence
  Description of Artificial Sequence: Synthetic peptide
AAS

SEQ ID NO: 479 - DNA, 30 bp, Artificial Sequence; identical to SEQ ID NO: 15
  Description of Artificial Sequence: Synthetic oligonucleotide

SEQ ID NO: 480 - protein, 10 aa, Artificial Sequence
  Description of Artificial Sequence: Synthetic peptide
QQSYSTPPIT

SEQ ID NO: 481 - DNA, 372 bp, Artificial Sequence
  Description of Artificial Sequence: Synthetic polynucleotide
gaagtgcagctggtggagtctgggggaggcttggtacagcctggcaggtccctgaaactctcctgtacagcctctggattcacctttgctgattataccatgcactgggtccgacaaggtccagggaagggcctggagtgggtctcagatattagttggaatagtggtagtaaaggctatgcggactctgtgaagggccgattcaccatctccagagacaacgccaagaactccctgtatctgcaaatgaacagtctgagaactgaggacacggccttgtattactgtgcaaaagatatgagtggctacgcccactactactactacgctttggacgtctggggccaagggaccacggtcaccgtctcctca

SEQ ID NO: 482 - protein, 124 aa, Artificial Sequence
  Description of Artificial Sequence: Synthetic polypeptide
EVQLVESGGGLVQPGRSLKLSCTASGFTFADYTMHWVRQGPGKGLEWVSDISWNSGSKGYADSVKGRFTISRDNAKNSLYLQMNSLRTEDTALYYCAKDMSGYAHYYYYALDVWGQGTTVTVSS

SEQ ID NO: 483 - DNA, 24 bp, Artificial Sequence
  Description of Artificial Sequence: Synthetic oligonucleotide
ggattcacctttgctgattatacc

SEQ ID NO: 484 - protein, 8 aa, Artificial Sequence
  Description of Artificial Sequence: Synthetic peptide
GFTFADYT

SEQ ID NO: 485 - DNA, 24 bp, Artificial Sequence
  Description of Artificial Sequence: Synthetic oligonucleotide
attagttggaatagtggtagtaaa

SEQ ID NO: 486 - protein, 8 aa, Artificial Sequence
  Description of Artificial Sequence: Synthetic peptide
ISWNSGSK

SEQ ID NO: 487 - DNA, 51 bp, Artificial Sequence
  Description of Artificial Sequence: Synthetic oligonucleotide
gcaaaagatatgagtggctacgcccactactactactacgctttggacgtc

SEQ ID NO: 488 - protein, 17 aa, Artificial Sequence
  Description of Artificial Sequence: Synthetic peptide
AKDMSGYAHYYYYALDV

SEQ ID NO: 489 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccccccgatcaccttcggccaagggacacgactggagattaaa

SEQ ID NO: 490 - protein, 108 aa, Artificial Sequence
  Description of Artificial Sequence: Synthetic polypeptide
DIQMTQSPSSLSASVGDRVTITCRASQSISNYLNWYQQKPGKAPKLLIYAASSLQSGVPSRFSGSGSGTDFTLTISSLQPEDFATYYCQQSYSNPPITFGQGTRLEIK

SEQ ID NO: 491 - DNA, 18 bp, Artificial Sequence
  Description of Artificial Sequence: Synthetic oligonucleotide
cagagcattagcaactat

SEQ ID NO: 492 - protein, 6 aa, Artificial Sequence
  Description of Artificial Sequence: Synthetic peptide
QSISNY

SEQ ID NO: 493 - DNA, 9 bp, Artificial Sequence
  Description of Artificial Sequence: Synthetic oligonucleotide
gctgcatcc

SEQ ID NO: 494 - protein, 3 aa, Artificial Sequence
  Description of Artificial Sequence: Synthetic peptide
AAS

SEQ ID NO: 495 - DNA, 30 bp, Artificial Sequence
  Description of Artificial Sequence: Synthetic oligonucleotide
caacagagttacagtaaccccccgatcacc

SEQ ID NO: 496 - protein, 10 aa, Artificial Sequence
  Description of Artificial Sequence: Synthetic peptide
QQSYSNPPIT

SEQ ID NO: 497 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagaaaaggcatgcactgggtccgccaggctccagtcaaggggctggagtgggtggcagttatatcatatgatggaagtaataaatactatgcagactccgtgaagggccgattcaccatctccagagacaattccaagaacacgctgtatctgcaaatgaacagcctgacagctgaggacacggctgtgtattactgtgcgaaagaaggggggcatgactatggtggtacctttgactactggggccagggaaccctggtcaccgtctcctca

SEQ ID NO: 498 - protein, 121 aa, Artificial Sequence
  Description of Artificial Sequence: Synthetic polypeptide
QVQLVESGGGVVQPGRSLRLSCAASGFTFSRKGMHWVRQAPVKGLEWVAVISYDGSNKYYADSVKGRFTISRDNSKNTLYLQMNSLTAEDTAVYYCAKEGGHDYGGTFDYWGQGTLVTVSS

SEQ ID NO: 499 - DNA, 24 bp, Artificial Sequence
  Description of Artificial Sequence: Synthetic oligonucleotide
ggattcaccttcagtagaaaaggc

SEQ ID NO: 500 - protein, 8 aa, Artificial Sequence
  Description of Artificial Sequence: Synthetic peptide
GFTFSRKG

SEQ ID NO: 501 - DNA, 24 bp, Artificial Sequence
  Description of Artificial Sequence: Synthetic oligonucleotide
atatcatatgatggaagtaataaa

SEQ ID NO: 502 - protein, 8 aa, Artificial Sequence
  Description of Artificial Sequence: Synthetic peptide
ISYDGSNK

SEQ ID NO: 503 - DNA, 42 bp, Artificial Sequence
  Description of Artificial Sequence: Synthetic oligonucleotide
gcgaaagaaggggggcatgactatggtggtacctttgactac

SEQ ID NO: 504 - protein, 14 aa, Artificial Sequence
  Description of Artificial Sequence: Synthetic peptide
AKEGGHDYGGTFDY

SEQ ID NO: 505 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattaacaactatttaaattggtatcagcagaaaccagggaaagcccctaagttcctgatctacgatgcatccaatttggaaacaggggtcccatcaaggttcagtggaagtggatctgggacagattttactttcaccatcagcagcctgcagcctgaagatattgcaacatattactgtcaacagtatgatgatctcccattcactttcggccctgggaccaaagtggatatcaaa

SEQ ID NO: 506 - protein, 107 aa, Artificial Sequence
  Description of Artificial Sequence: Synthetic polypeptide
DIQMTQSPSSLSASVGDRVTITCQASQDINNYLNWYQQKPGKAPKFLIYDASNLETGVPSRFSGSGSGTDFTFTISSLQPEDIATYYCQQYDDLPFTFGPGTKVDIK

SEQ ID NO: 507 - DNA, 18 bp, Artificial Sequence
  Description of Artificial Sequence: Synthetic oligonucleotide
caggacattaacaactat

SEQ ID NO: 508 - protein, 6 aa, Artificial Sequence
  Description of Artificial Sequence: Synthetic peptide
QDINNY

SEQ ID NO: 509 - DNA, 9 bp, Artificial Sequence
  Description of Artificial Sequence: Synthetic oligonucleotide
gatgcatcc

SEQ ID NO: 510 - protein, 3 aa, Artificial Sequence
  Description of Artificial Sequence: Synthetic peptide
DAS

SEQ ID NO: 511 - DNA, 27 bp, Artificial Sequence
  Description of Artificial Sequence: Synthetic oligonucleotide
caacagtatgatgatctcccattcact

SEQ ID NO: 512 - protein, 9 aa, Artificial Sequence
  Description of Artificial Sequence: Synthetic peptide
QQYDDLPFT

SEQ ID NO: 513 - DNA, 369 bp, Artificial Sequence
  Description of Artificial Sequence: Synthetic polynucleotide
gaagtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaatagtggtagtataggctatgcggactctgtgaagggccgattcaccatctccagagacaacgccaagaagtccctgtatctgcaaatgaacagtctgagagctgaggacacggccttgtattactgtgcaaaagataatagtggctacggtcactactactacggaatggacgtctggggccaagggaccacggtcaccgtcgcctca

SEQ ID NO: 514 - protein, 123 aa, Artificial Sequence
  Description of Artificial Sequence: Synthetic polypeptide
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 515 - DNA, 24 bp, Artificial Sequence
  Description of Artificial Sequence: Synthetic oligonucleotide
ggattcacctttgatgattatacc

SEQ ID NO: 516 - protein, 8 aa, Artificial Sequence
  Description of Artificial Sequence: Synthetic peptide
GFTFDDYT

SEQ ID NO: 517 - DNA, 24 bp, Artificial Sequence
  Description of Artificial Sequence: Synthetic oligonucleotide
attagttggaatagtggtagtata

SEQ ID NO: 518 - protein, 8 aa, Artificial Sequence
  Description of Artificial Sequence: Synthetic peptide
ISWNSGSI

SEQ ID NO: 519 - DNA, 48 bp, Artificial Sequence
  Description of Artificial Sequence: Synthetic oligonucleotide
gcaaaagataatagtggctacggtcactactactacggaatggacgtc

SEQ ID NO: 520 - protein, 16 aa, Artificial Sequence
  Description of Artificial Sequence: Synthetic peptide
AKDNSGYGHYYYGMDV

SEQ ID NO: 521 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaaa

SEQ ID NO: 522 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 523 - DNA, 18 bp, Artificial Sequence
  Description of Artificial Sequence: Synthetic oligonucleotide
cagagtgttagcagcaac

SEQ ID NO: 524 - protein, 6 aa, Artificial Sequence
  Description of Artificial Sequence: Synthetic peptide
QSVSSN

SEQ ID NO: 525 - DNA, 9 bp, Artificial Sequence
  Description of Artificial Sequence: Synthetic oligonucleotide
ggtgcatcc

SEQ ID NO: 526 - protein, 3 aa, Artificial Sequence
  Description of Artificial Sequence: Synthetic peptide
GAS

SEQ ID NO: 527 - DNA, 27 bp, Artificial Sequence
  Description of Artificial Sequence: Synthetic oligonucleotide
cagcactatattaactggcctctcact

SEQ ID NO: 528 - protein, 9 aa, Artificial Sequence
  Description of Artificial Sequence: Synthetic peptide
QHYINWPLT

SEQ ID NO: 529 - DNA, 369 bp, Artificial Sequence; identical to SEQ ID NO: 513
  Description of Artificial Sequence: Synthetic polynucleotide

SEQ ID NO: 530 - protein, 123 aa, Artificial Sequence; identical to SEQ ID NO: 514
  Description of Artificial Sequence: Synthetic polypeptide

SEQ ID NO: 531 - DNA, 24 bp, Artificial Sequence
  Description of Artificial Sequence: Synthetic oligonucleotide
ggattcacctttgatgattatacc

SEQ ID NO: 532 - protein, 8 aa, Artificial Sequence
  Description of Artificial Sequence: Synthetic peptide
GFTFDDYT

SEQ ID NO: 533 - DNA, 24 bp, Artificial Sequence
  Description of Artificial Sequence: Synthetic oligonucleotide
attagttggaatagtggtagtata

SEQ ID NO: 534 - protein, 8 aa, Artificial Sequence
  Description of Artificial Sequence: Synthetic peptide
ISWNSGSI

SEQ ID NO: 535 - DNA, 48 bp, Artificial Sequence; identical to SEQ ID NO: 519
  Description of Artificial Sequence: Synthetic oligonucleotide

SEQ ID NO: 536 - protein, 16 aa, Artificial Sequence
  Description of Artificial Sequence: Synthetic peptide
AKDNSGYGHYYYGMDV

SEQ ID NO: 537 - DNA, 321 bp, Artificial Sequence; identical to SEQ ID NO: 521
  Description of Artificial Sequence: Synthetic polynucleotide

SEQ ID NO: 538 - protein, 107 aa, Artificial Sequence; identical to SEQ ID NO: 522
  Description of Artificial Sequence: Synthetic polypeptide

SEQ ID NO: 539 - DNA, 18 bp, Artificial Sequence
  Description of Artificial Sequence: Synthetic oligonucleotide
cagagtgttagcagcaac

SEQ ID NO: 540 - protein, 6 aa, Artificial Sequence
  Description of Artificial Sequence: Synthetic peptide
QSVSSN

SEQ ID NO: 541 - DNA, 9 bp, Artificial Sequence
  Description of Artificial Sequence: Synthetic oligonucleotide
ggtgcatcc

SEQ ID NO: 542 - protein, 3 aa, Artificial Sequence
  Description of Artificial Sequence: Synthetic peptide
GAS

SEQ ID NO: 543 - DNA, 27 bp, Artificial Sequence
  Description of Artificial Sequence: Synthetic oligonucleotide
cagcactatattaactggcctctcact

SEQ ID NO: 544 - protein, 9 aa, Artificial Sequence
  Description of Artificial Sequence: Synthetic peptide
QHYINWPLT

SEQ ID NO: 545 - DNA, 354 bp, Artificial Sequence
  Description of Artificial Sequence: Synthetic polynucleotide
caggtgcagttggtggagtctgggggaggcgtggtccagcctgggaggtccctgagactctcctgtggtgcgtctggattcaccttcagaagttatggcatgcactgggtccgccagactccaggcagggggctggagtgggtggcaatgatatattatgatggaaataataaatactatgcagactccgtgaggggccgattcaccgtttccagagacaattccaagaacaccctgtatctgcaaatgagcagcctgagagccgaggacacggctctatatttctgtgcgcgagggcctgggtacaactggctcgacccctggggccagggaaccctggtcaccgtctcctca

SEQ ID NO: 546 - protein, 118 aa, Artificial Sequence
  Description of Artificial Sequence: Synthetic polypeptide
QVQLVESGGGVVQPGRSLRLSCGASGFTFRSYGMHWVRQTPGRGLEWVAMIYYDGNNKYYADSVRGRFTVSRDNSKNTLYLQMSSLRAEDTALYFCARGPGYNWLDPWGQGTLVTVSS

SEQ ID NO: 547 - DNA, 24 bp, Artificial Sequence
  Description of Artificial Sequence: Synthetic oligonucleotide
ggattcaccttcagaagttatggc

SEQ ID NO: 548 - protein, 8 aa, Artificial Sequence
  Description of Artificial Sequence: Synthetic peptide
GFTFRSYG

SEQ ID NO: 549 - DNA, 24 bp, Artificial Sequence
  Description of Artificial Sequence: Synthetic oligonucleotide
atatattatgatggaaataataaa

SEQ ID NO: 550 - protein, 8 aa, Artificial Sequence
  Description of Artificial Sequence: Synthetic peptide
IYYDGNNK

SEQ ID NO: 551 - DNA, 33 bp, Artificial Sequence
  Description of Artificial Sequence: Synthetic oligonucleotide
gcgcgagggcctgggtacaactggctcgacccc

SEQ ID NO: 552 - protein, 11 aa, Artificial Sequence
  Description of Artificial Sequence: Synthetic peptide
ARGPGYNWLDP

SEQ ID NO: 553 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtattagcaggaacttggcctggtaccagcaraaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataaccggcctctcactttcggcggagggaccgaggtggagatcaaa

SEQ ID NO: 554 - protein, 107 aa, Artificial Sequence
  Description of Artificial Sequence: Synthetic polypeptide
  MOD_RES (38)..(38): Any amino acid
EIVMTQSPATLSVSPGERATLSCRASQSISRNLAWYQXKPGQAPRLLIYGASTRATGIPARFSGSGSGTEFTLTISSLQSEDFAVYYCQQYNNRPLTFGGGTEVEIK

SEQ ID NO: 555 - DNA, 18 bp, Artificial Sequence
  Description of Artificial Sequence: Synthetic oligonucleotide
cagagtattagcaggaac

SEQ ID NO: 556 - protein, 6 aa, Artificial Sequence
  Description of Artificial Sequence: Synthetic peptide
QSISRN

SEQ ID NO: 557 - DNA, 9 bp, Artificial Sequence
  Description of Artificial Sequence: Synthetic oligonucleotide
ggtgcatcc

SEQ ID NO: 558 - protein, 3 aa, Artificial Sequence
  Description of Artificial Sequence: Synthetic peptide
GAS

SEQ ID NO: 559 - DNA, 27 bp, Artificial Sequence
  Description of Artificial Sequence: Synthetic oligonucleotide
cagcagtataataaccggcctctcact

SEQ ID NO: 560 - protein, 9 aa, Artificial Sequence
  Description of Artificial Sequence: Synthetic peptide
QQYNNRPLT

SEQ ID NO: 561 - DNA, 354 bp, Artificial Sequence
  Description of Artificial Sequence: Synthetic polynucleotide
caggtgcagttggtggagtctgggggaggcgtggtccagcctgggaggtccctgagactcgcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacactgtatctgcaaatgaacaatctgagagtcgaggacacggctatgtatttctgtgcgcgagggcctgggtacaattggctcgacccctggggccagggaaccctggtcactgtttcctca

SEQ ID NO: 562 - protein, 118 aa, Artificial Sequence
  Description of Artificial Sequence: Synthetic polypeptide
QVQLVESGGGVVQPGRSLRLACVASGFTFRSYGMHWVRQAPGKGLQWVAMIYYDGKNKYYADSVRGRFTISRDNSKNTLYLQMNNLRVEDTAMYFCARGPGYNWLDPWGQGTLVTVSS

SEQ ID NO: 563 - DNA, 24 bp, Artificial Sequence
  Description of Artificial Sequence: Synthetic oligonucleotide
ggattcaccttcagaagttatggc

SEQ ID NO: 564 - protein, 8 aa, Artificial Sequence
  Description of Artificial Sequence: Synthetic peptide
GFTFRSYG

SEQ ID NO: 565 - DNA, 24 bp, Artificial Sequence
  Description of Artificial Sequence: Synthetic oligonucleotide
atttactatgatggtaagaataaa

SEQ ID NO: 566 - protein, 8 aa, Artificial Sequence
  Description of Artificial Sequence: Synthetic peptide
IYYDGKNK

SEQ ID NO: 567 - DNA, 33 bp, Artificial Sequence
  Description of Artificial Sequence: Synthetic oligonucleotide
gcgcgagggcctgggtacaattggctcgacccc

SEQ ID NO: 568 - protein, 11 aa, Artificial Sequence
  Description of Artificial Sequence: Synthetic peptide
ARGPGYNWLDP

SEQ ID NO: 569 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagacttcactctcaccatcagcagcctgcagtctgaggatgttgcagtttattactgtcagcaacatcataactggcctctcactttcggcggagggaccaaggtggagatcaaa

SEQ ID NO: 570 - protein, 107 aa, Artificial Sequence
  Description of Artificial Sequence: Synthetic polypeptide
EIVMTQSPATLSVSPGERATLSCRASQRISSNLAWYQQKPGQAPRLLIYGASTRATGSPARFSGSGSGTDFTLTISSLQSEDVAVYYCQQHHNWPLTFGGGTKVEIK

SEQ ID NO: 571 - DNA, 18 bp, Artificial Sequence
  Description of Artificial Sequence: Synthetic oligonucleotide
cagagaattagcagcaac

SEQ ID NO: 572 - protein, 6 aa, Artificial Sequence
  Description of Artificial Sequence: Synthetic peptide
QRISSN

SEQ ID NO: 573 - DNA, 9 bp, Artificial Sequence
  Description of Artificial Sequence: Synthetic oligonucleotide
ggtgcatcc

SEQ ID NO: 574 - protein, 3 aa, Artificial Sequence
  Description of Artificial Sequence: Synthetic peptide
GAS

SEQ ID NO: 575 - DNA, 27 bp, Artificial Sequence
  Description of Artificial Sequence: Synthetic oligonucleotide
cagcaacatcataactggcctctcact

SEQ ID NO: 576 - protein, 9 aa, Artificial Sequence
  Description of Artificial Sequence: Synthetic peptide
QQHHNWPLT

SEQ ID NO: 577 - DNA, 354 bp, Artificial Sequence
  Description of Artificial Sequence: Synthetic polynucleotide
caggtgcagctggtggagtctgggggaggcgtggtccagcctgggaggtccctgagactctcctgtgctgcgtctggatttaccttcagaagttatgccatgcactgggtccgccaggctccaggcaaggggctggagtgggtggcaatggtatactatgatggaaataatcaatactatgcagactccgtgaggggccgattcaccatctccagagacaattccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 578 - protein, 118 aa, Artificial Sequence
  Description of Artificial Sequence: Synthetic polypeptide
QVQLVESGGGVVQPGRSLRLSCAASGFTFRSYAMHWVRQAPGKGLEWVAMVYYDGNNQYYADSVRGRFTISRDNSKNTLYLQMNSLRADDTAVYFCARGPGYNWLDPWGQGTLVTVSS

SEQ ID NO: 579 - DNA, 24 bp, Artificial Sequence
  Description of Artificial Sequence: Synthetic oligonucleotide
ggatttaccttcagaagttatgcc

SEQ ID NO: 580 - protein, 8 aa, Artificial Sequence
  Description of Artificial Sequence: Synthetic peptide
GFTFRSYA

SEQ ID NO: 581 - DNA, 24 bp, Artificial Sequence
  Description of Artificial Sequence: Synthetic oligonucleotide
gtatactatgatggaaataatcaa

SEQ ID NO: 582 - protein, 8 aa, Artificial Sequence
  Description of Artificial Sequence: Synthetic peptide
VYYDGNNQ

SEQ ID NO: 583 - DNA, 33 bp, Artificial Sequence; identical to SEQ ID NO: 551
  Description of Artificial Sequence: Synthetic oligonucleotide

SEQ ID NO: 584 - protein, 11 aa, Artificial Sequence
  Description of Artificial Sequence: Synthetic peptide
ARGPGYNWLDP

SEQ ID NO: 585 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcaggaacttggcctggtaccagcaaaaacctggccaggctcccaggctcctcatctatggtgcatccaccagggccactggtatcccggccaggttcagtggcagtgggtctgggacagacttcactctcaccatcagcagcctgcagtctgaagattttgcagtttattactgtcagcagtataataactggcctctcactttcggcggagggaccaaggtggtgatcaaa

SEQ ID NO: 586 - protein, 107 aa, Artificial Sequence
  Description of Artificial Sequence: Synthetic polypeptide
EIVMTQSPATLSVSPGERATLSCRASQSVSRNLAWYQQKPGQAPRLLIYGASTRATGIPARFSGSGSGTDFTLTISSLQSEDFAVYYCQQYNNWPLTFGGGTKVVIK

SEQ ID NO: 587 - DNA, 18 bp, Artificial Sequence
  Description of Artificial Sequence: Synthetic oligonucleotide
cagagtgttagcaggaac

SEQ ID NO: 588 - protein, 6 aa, Artificial Sequence
  Description of Artificial Sequence: Synthetic peptide
QSVSRN

SEQ ID NO: 589 - DNA, 9 bp, Artificial Sequence
  Description of Artificial Sequence: Synthetic oligonucleotide
ggtgcatcc

SEQ ID NO: 590 - protein, 3 aa, Artificial Sequence
  Description of Artificial Sequence: Synthetic peptide
GAS

SEQ ID NO: 591 - DNA, 27 bp, Artificial Sequence
  Description of Artificial Sequence: Synthetic oligonucleotide
cagcagtataataactggcctctcact

SEQ ID NO: 592 - protein, 9 aa, Artificial Sequence
  Description of Artificial Sequence: Synthetic peptide
QQYNNWPLT

SEQ ID NO: 593 - DNA, 354 bp, Artificial Sequence
  Description of Artificial Sequence: Synthetic polynucleotide
caggtgcagctggtggagtctgggggaggcgtggtccagcctgggaggtccctgagactctcctgtattgcgtctggatttaccttcagaagttatggcatgcactgggtccgccaggctccaggcaaggggctggagtgggtggcaatgatatattatgatggaaacaataaatactatgcagactccgtgaggggccgattcaccatctccagagacaactccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 594 - protein, 118 aa, Artificial Sequence
  Description of Artificial Sequence: Synthetic polypeptide
QVQLVESGGGVVQPGRSLRLSCIASGFTFRSYGMHWVRQAPGKGLEWVAMIYYDGNNKYYADSVRGRFTISRDNSKNTLYLQMNSLRADDTAVYFCARGPGYNWLDPWGQGTLVTVSS

SEQ ID NO: 595 - DNA, 24 bp, Artificial Sequence
  Description of Artificial Sequence: Synthetic oligonucleotide
ggatttaccttcagaagttatggc

SEQ ID NO: 596 - protein, 8 aa, Artificial Sequence
  Description of Artificial Sequence: Synthetic peptide
GFTFRSYG

SEQ ID NO: 597 - DNA, 24 bp, Artificial Sequence
  Description of Artificial Sequence: Synthetic oligonucleotide
atatattatgatggaaacaataaa

SEQ ID NO: 598 - protein, 8 aa, Artificial Sequence
  Description of Artificial Sequence: Synthetic peptide
IYYDGNNK

SEQ ID NO: 599 - DNA, 33 bp, Artificial Sequence; identical to SEQ ID NO: 551
  Description of Artificial Sequence: Synthetic oligonucleotide

SEQ ID NO: 600 - protein, 11 aa, Artificial Sequence
  Description of Artificial Sequence: Synthetic peptide
ARGPGYNWLDP

SEQ ID NO: 601 - DNA, 321 bp, Artificial Sequence
  Description of Artificial Sequence: Synthetic polynucleotide
gaaatagtgatgacgcagtctccagccacactgtctgtgtctccaggggaaagagccaccctctcctgcagggccagtcagagtgttagcagcaacttggcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataacaggcctctcactttcggcggagggaccaaggtggagatcaaa

SEQ ID NO: 602 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNRPLTFGGGTKVEIK

SEQ ID NO: 603 - DNA, 18 bp, Artificial Sequence
  Description of Artificial Sequence: Synthetic oligonucleotide
cagagtgttagcagcaac

SEQ ID NO: 604 - protein, 6 aa, Artificial Sequence
  Description of Artificial Sequence: Synthetic peptide
QSVSSN

SEQ ID NO: 605 - DNA, 9 bp, Artificial Sequence
  Description of Artificial Sequence: Synthetic oligonucleotide
ggtgcatcc

SEQ ID NO: 606 - protein, 3 aa, Artificial Sequence
  Description of Artificial Sequence: Synthetic peptide
GAS

SEQ ID NO: 607 - DNA, 27 bp, Artificial Sequence
  Description of Artificial Sequence: Synthetic oligonucleotide
cagcagtataataacaggcctctcact

SEQ ID NO: 608 - protein, 9 aa, Artificial Sequence
  Description of Artificial Sequence: Synthetic peptide
QQYNNRPLT

SEQ ID NO: 609 - DNA, 354 bp, Artificial Sequence
  Description of Artificial Sequence: Synthetic polynucleotide
caggtgcagctggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 610 - protein, 118 aa, Artificial Sequence
  Description of Artificial Sequence: Synthetic polypeptide
QVQLVESGGGVVQPGRSLRLSCAASGFTFRSFGMHWVRQAPGRGLEWVAMIYFDGKNKYYADSVRGRFTISRDNSKNTLYLEMSSLRAEDTAVYFCARGPGYNWLDPWGQGTLVTVSS

SEQ ID NO: 611 - DNA, 24 bp, Artificial Sequence
  Description of Artificial Sequence: Synthetic oligonucleotide
ggattcaccttcagaagttttggc

SEQ ID NO: 612 - protein, 8 aa, Artificial Sequence
  Description of Artificial Sequence: Synthetic peptide
GFTFRSFG

SEQ ID NO: 613 - DNA, 24 bp, Artificial Sequence
  Description of Artificial Sequence: Synthetic oligonucleotide
atatattttgatggaaaaaataaa

SEQ ID NO: 614 - protein, 8 aa, Artificial Sequence
  Description of Artificial Sequence: Synthetic peptide
IYFDGKNK

SEQ ID NO: 615 - DNA, 33 bp, Artificial Sequence; identical to SEQ ID NO: 551
  Description of Artificial Sequence: Synthetic oligonucleotide

SEQ ID NO: 616 - protein, 11 aa, Artificial Sequence
  Description of Artificial Sequence: Synthetic peptide
ARGPGYNWLDP

SEQ ID NO: 617 - DNA, 321 bp, Artificial Sequence
  Description of Artificial Sequence: Synthetic polynucleotide
gaaatagtgatgacgcagtctccagccaccctgtctgtgtctccaggggaaagagtcaccctctcctgtagggccagtcagagtattagcaggaacttggcctggtaccagcagaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 618 - protein, 107 aa, Artificial Sequence
  Description of Artificial Sequence: Synthetic polypeptide
EIVMTQSPATLSVSPGERVTLSCRASQSISRNLAWYQQKPGQAPRLLIYGASTRATGVPARFSGSGSGTEFTLTISSLQSEDFAVFHCQQYNNRPLTFGGGTEVEIK

SEQ ID NO: 619 - DNA, 18 bp, Artificial Sequence
  Description of Artificial Sequence: Synthetic oligonucleotide
cagagtattagcaggaac

SEQ ID NO: 620 - protein, 6 aa, Artificial Sequence
  Description of Artificial Sequence: Synthetic peptide
QSISRN

SEQ ID NO: 621 - DNA, 9 bp, Artificial Sequence
  Description of Artificial Sequence: Synthetic oligonucleotide
ggtgcatcc

SEQ ID NO: 622 - protein, 3 aa, Artificial Sequence
  Description of Artificial Sequence: Synthetic peptide
GAS

SEQ ID NO: 623 - DNA, 27 bp, Artificial Sequence
  Description of Artificial Sequence: Synthetic oligonucleotide
cagcagtataataataggcctctcact

SEQ ID NO: 624 - protein, 9 aa, Artificial Sequence
  Description of Artificial Sequence: Synthetic peptide
QQYNNRPLT

SEQ ID NO: 625 - DNA, 354 bp, Artificial Sequence
  Description of Artificial Sequence: Synthetic polynucleotide
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 626 - protein, 118 aa, Artificial Sequence; identical to SEQ ID NO: 610
  Description of Artificial Sequence: Synthetic polypeptide

SEQ ID NO: 627 - DNA, 24 bp, Artificial Sequence
  Description of Artificial Sequence: Synthetic oligonucleotide
ggattcaccttcagaagttttggc

SEQ ID NO: 628 - protein, 8 aa, Artificial Sequence
  Description of Artificial Sequence: Synthetic peptide
GFTFRSFG

SEQ ID NO: 629 - DNA, 24 bp, Artificial Sequence
  Description of Artificial Sequence: Synthetic oligonucleotide
atatattttgatggaaaaaataaa

SEQ ID NO: 630 - protein, 8 aa, Artificial Sequence
  Description of Artificial Sequence: Synthetic peptide
IYFDGKNK

SEQ ID NO: 631 - DNA, 33 bp, Artificial Sequence; identical to SEQ ID NO: 551
  Description of Artificial Sequence: Synthetic oligonucleotide

SEQ ID NO: 632 - protein, 11 aa, Artificial Sequence
  Description of Artificial Sequence: Synthetic peptide
ARGPGYNWLDP

SEQ ID NO: 633 - DNA, 321 bp, Artificial Sequence
  Description of Artificial Sequence: Synthetic polynucleotide
gaaatagtgatgacgcagtctccagccaccctgtctgtgtctccaggggaaagagtcaccctctcctgtagggccagtcagagtattagcaggaacttggcctggtaccagcaraaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 634 - protein, 107 aa, Artificial Sequence
  Description of Artificial Sequence: Synthetic polypeptide
  MOD_RES (38)..(38): Any amino acid
EIVMTQSPATLSVSPGERVTLSCRASQSISRNLAWYQXKPGQAPRLLIYGASTRATGVPARFSGSGSGTEFTLTISSLQSEDFAVFHCQQYNNRPLTFGGGTEVEIK

SEQ ID NO: 635 - DNA, 18 bp, Artificial Sequence
  Description of Artificial Sequence: Synthetic oligonucleotide
cagagtattagcaggaac

SEQ ID NO: 636 - protein, 6 aa, Artificial Sequence
  Description of Artificial Sequence: Synthetic peptide
QSISRN

SEQ ID NO: 637 - DNA, 9 bp, Artificial Sequence
  Description of Artificial Sequence: Synthetic oligonucleotide
ggtgcatcc

SEQ ID NO: 638 - protein, 3 aa, Artificial Sequence
  Description of Artificial Sequence: Synthetic peptide
GAS

SEQ ID NO: 639 - DNA, 27 bp, Artificial Sequence
  Description of Artificial Sequence: Synthetic oligonucleotide
cagcagtataataataggcctctcact

SEQ ID NO: 640 - protein, 9 aa, Artificial Sequence
  Description of Artificial Sequence: Synthetic peptide
QQYNNRPLT

SEQ ID NO: 641 - DNA, 354 bp, Artificial Sequence
  Description of Artificial Sequence: Synthetic polynucleotide
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagcagcctgagagccgaggacacggctgtatatttctgtgcgcgagggcctgggtacaattggctcgacccctggggccagggaaccctggtcaccgtctcctca

SEQ ID NO: 642 - protein, 118 aa, Artificial Sequence; identical to SEQ ID NO: 610
  Description of Artificial Sequence: Synthetic polypeptide

SEQ ID NO: 643 - DNA, 24 bp, Artificial Sequence
  Description of Artificial Sequence: Synthetic oligonucleotide
ggattcaccttcagaagttttggc

SEQ ID NO: 644 - protein, 8 aa, Artificial Sequence
  Description of Artificial Sequence: Synthetic peptide
GFTFRSFG

SEQ ID NO: 645 - DNA, 24 bp, Artificial Sequence
  Description of Artificial Sequence: Synthetic oligonucleotide
atatattttgatggaaaaaataaa

SEQ ID NO: 646 - protein, 8 aa, Artificial Sequence
  Description of Artificial Sequence: Synthetic peptide
IYFDGKNK

SEQ ID NO: 647 - DNA, 33 bp, Artificial Sequence; identical to SEQ ID NO: 567
  Description of Artificial Sequence: Synthetic oligonucleotide

SEQ ID NO: 648 - protein, 11 aa, Artificial Sequence
  Description of Artificial Sequence: Synthetic peptide
ARGPGYNWLDP

SEQ ID NO: 649 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgtagggccagtcagagtgttagcaggaacttggcctggtaccagcaaaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 650 - protein, 107 aa, Artificial Sequence
  Description of Artificial Sequence: Synthetic polypeptide
EIVMTQSPATLSVSPGERATLSCRASQSVSRNLAWYQQKPGQAPRLLIYGASTRATGVPARFSGSGSGTEFTLTISSLQSEDFAVFHCQQYNNRPLTFGGGTEVEIK

SEQ ID NO: 651 - DNA, 18 bp, Artificial Sequence
  Description of Artificial Sequence: Synthetic oligonucleotide
cagagtgttagcaggaac

SEQ ID NO: 652 - protein, 6 aa, Artificial Sequence
  Description of Artificial Sequence: Synthetic peptide
QSVSRN

SEQ ID NO: 653 - DNA, 9 bp, Artificial Sequence
  Description of Artificial Sequence: Synthetic oligonucleotide
ggtgcatcc

SEQ ID NO: 654 - protein, 3 aa, Artificial Sequence
  Description of Artificial Sequence: Synthetic peptide
GAS

SEQ ID NO: 655 - DNA, 27 bp, Artificial Sequence
  Description of Artificial Sequence: Synthetic oligonucleotide
cagcagtataataataggcctctcact

SEQ ID NO: 656 - protein, 9 aa, Artificial Sequence
  Description of Artificial Sequence: Synthetic peptide
QQYNNRPLT

SEQ ID NO: 657 - DNA, 354 bp, Artificial Sequence; identical to SEQ ID NO: 641
  Description of Artificial Sequence: Synthetic polynucleotide

SEQ ID NO: 658 - protein, 118 aa, Artificial Sequence; identical to SEQ ID NO: 610
  Description of Artificial Sequence: Synthetic polypeptide

SEQ ID NO: 659 - DNA, 24 bp, Artificial Sequence
  Description of Artificial Sequence: Synthetic oligonucleotide
ggattcaccttcagaagttttggc

SEQ ID NO: 660 - protein, 8 aa, Artificial Sequence
  Description of Artificial Sequence: Synthetic peptide
GFTFRSFG

SEQ ID NO: 661 - DNA, 24 bp, Artificial Sequence
  Description of Artificial Sequence: Synthetic oligonucleotide
atatattttgatggaaaaaataaa

SEQ ID NO: 662 - protein, 8 aa, Artificial Sequence
  Description of Artificial Sequence: Synthetic peptide
IYFDGKNK

SEQ ID NO: 663 - DNA, 33 bp, Artificial Sequence; identical to SEQ ID NO: 567
  Description of Artificial Sequence: Synthetic oligonucleotide

SEQ ID NO: 664 - protein, 11 aa, Artificial Sequence
  Description of Artificial Sequence: Synthetic peptide
ARGPGYNWLDP

SEQ ID NO: 665 - DNA, 321 bp, Artificial Sequence; identical to SEQ ID NO: 649
  Description of Artificial Sequence: Synthetic polynucleotide

SEQ ID NO: 666 - protein, 107 aa, Artificial Sequence; identical to SEQ ID NO: 650
  Description of Artificial Sequence: Synthetic polypeptide

SEQ ID NO: 667 - DNA, 18 bp, Artificial Sequence
  Description of Artificial Sequence: Synthetic oligonucleotide
cagagtgttagcaggaac

SEQ ID NO: 668 - protein, 6 aa, Artificial Sequence
  Description of Artificial Sequence: Synthetic peptide
QSVSRN

SEQ ID NO: 669 - DNA, 9 bp, Artificial Sequence
  Description of Artificial Sequence: Synthetic oligonucleotide
ggtgcatcc

SEQ ID NO: 670 - protein, 3 aa, Artificial Sequence
  Description of Artificial Sequence: Synthetic peptide
GAS

SEQ ID NO: 671 - DNA, 27 bp, Artificial Sequence
  Description of Artificial Sequence: Synthetic oligonucleotide
cagcagtataataataggcctctcact

SEQ ID NO: 672 - protein, 9 aa, Artificial Sequence
  Description of Artificial Sequence: Synthetic peptide
QQYNNRPLT

SEQ ID NO: 673 - DNA, 354 bp, Artificial Sequence
  Description of Artificial Sequence: Synthetic polynucleotide
caggtgcagttggtggagtctgggggaggcgtggtccagcctgggaggtccctgagactctcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacgctgtatctgcaaatgaacagtctgagagccgaagacacggctatgtatttctgtgcgcgagggcctgggtacaactggctcgacccctggggccagggaaccctggtcactgtctcctca

SEQ ID NO: 674 - protein, 118 aa, Artificial Sequence
  Description of Artificial Sequence: Synthetic polypeptide
QVQLVESGGGVVQPGRSLRLSCVASGFTFRSYGMHWVRQAPGKGLQWVAMIYYDGKNKYYADSVRGRFTISRDNSKNTLYLQMNSLRAEDTAMYFCARGPGYNWLDPWGQGTLVTVSS

SEQ ID NO: 675 - DNA, 24 bp, Artificial Sequence
  Description of Artificial Sequence: Synthetic oligonucleotide
ggattcaccttcagaagttatggc

SEQ ID NO: 676 - protein, 8 aa, Artificial Sequence
  Description of Artificial Sequence: Synthetic peptide
GFTFRSYG

SEQ ID NO: 677 - DNA, 24 bp, Artificial Sequence
  Description of Artificial Sequence: Synthetic oligonucleotide
atttactatgatggtaagaataaa

SEQ ID NO: 678 - protein, 8 aa, Artificial Sequence
  Description of Artificial Sequence: Synthetic peptide
IYYDGKNK

SEQ ID NO: 679 - DNA, 33 bp, Artificial Sequence; identical to SEQ ID NO: 551
  Description of Artificial Sequence: Synthetic oligonucleotide

SEQ ID NO: 680 - protein, 11 aa, Artificial Sequence
  Description of Artificial Sequence: Synthetic peptide
ARGPGYNWLDP

SEQ ID NO: 681 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagagttcactctcaccatcagcagcctgcagtctgaagatgttgcagtttattactgtcagcaacataataactggcctctcactttcggcggagggaccaaggtggagatcaaa

SEQ ID NO: 682 - protein, 107 aa, Artificial Sequence
  Description of Artificial Sequence: Synthetic polypeptide
EIVMTQSPATLSVSPGERATLSCRASQRISSNLAWYQQKPGQAPRLLIYGASTRATGSPARFSGSGSGTEFTLTISSLQSEDVAVYYCQQHNNWPLTFGGGTKVEIK

SEQ ID NO: 683 - DNA, 18 bp, Artificial Sequence
  Description of Artificial Sequence: Synthetic oligonucleotide
cagagaattagcagcaac

SEQ ID NO: 684 - protein, 6 aa, Artificial Sequence
  Description of Artificial Sequence: Synthetic peptide
QRISSN

SEQ ID NO: 685 - DNA, 9 bp, Artificial Sequence
  Description of Artificial Sequence: Synthetic oligonucleotide
ggtgcatcc

SEQ ID NO: 686 - protein, 3 aa, Artificial Sequence
  Description of Artificial Sequence: Synthetic peptide
GAS

SEQ ID NO: 687 - DNA, 27 bp, Artificial Sequence
  Description of Artificial Sequence: Synthetic oligonucleotide
cagcaacataataactggcctctcact

SEQ ID NO: 688 - protein, 9 aa, Artificial Sequence
  Description of Artificial Sequence: Synthetic peptide
QQHNNWPLT

SEQ ID NO: 689 - DNA, 354 bp, Artificial Sequence
  Description of Artificial Sequence: Synthetic polynucleotide
caggtgcaattggtggagtctgggggaggcgtggtccagccggggaggtccctgagactctcctgtgctgcgtctggtttcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 690 - protein, 118 aa, Artificial Sequence; identical to SEQ ID NO: 610
  Description of Artificial Sequence: Synthetic polypeptide

SEQ ID NO: 691 - DNA, 24 bp, Artificial Sequence
  Description of Artificial Sequence: Synthetic oligonucleotide
ggtttcaccttcagaagttttggc

SEQ ID NO: 692 - protein, 8 aa, Artificial Sequence
  Description of Artificial Sequence: Synthetic peptide
GFTFRSFG

SEQ ID NO: 693 - DNA, 24 bp, Artificial Sequence
  Description of Artificial Sequence: Synthetic oligonucleotide
atatattttgatggaaaaaataaa

SEQ ID NO: 694 - protein, 8 aa, Artificial Sequence
  Description of Artificial Sequence: Synthetic peptide
IYFDGKNK

SEQ ID NO: 695 - DNA, 33 bp, Artificial Sequence; identical to SEQ ID NO: 551
  Description of Artificial Sequence: Synthetic oligonucleotide

SEQ ID NO: 696 - protein, 11 aa, Artificial Sequence
  Description of Artificial Sequence: Synthetic peptide
ARGPGYNWLDP

SEQ ID NO: 697 - DNA, 321 bp, Artificial Sequence
  Description of Artificial Sequence: Synthetic polynucleotide
gaaatagtgatgacgcagtctccagccaccctgtctgtgtctccaggggaaagagtcatcctctcctgtagggccagtcagagtattagcaggaacttggcctggtaccagcaaaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 698 - protein, 107 aa, Artificial Sequence
  Description of Artificial Sequence: Synthetic polypeptide
EIVMTQSPATLSVSPGERVILSCRASQSISRNLAWYQQKPGQAPRLLIYGATTRATGVPARFSGSGSGTEFTLTISSLQSEDFAVFYCQQYNNRPLTFGGGTEVEIK

SEQ ID NO: 699 - DNA, 18 bp, Artificial Sequence
  Description of Artificial Sequence: Synthetic oligonucleotide
cagagtattagcaggaac

SEQ ID NO: 700 - protein, 6 aa, Artificial Sequence
  Description of Artificial Sequence: Synthetic peptide
QSISRN

SEQ ID NO: 701 - DNA, 9 bp, Artificial Sequence
  Description of Artificial Sequence: Synthetic oligonucleotide
ggtgcaacc

SEQ ID NO: 702 - protein, 3 aa, Artificial Sequence
  Description of Artificial Sequence: Synthetic peptide
GAT

SEQ ID NO: 703 - DNA, 27 bp, Artificial Sequence
  Description of Artificial Sequence: Synthetic oligonucleotide
cagcagtataataataggcctctcact

SEQ ID NO: 704 - protein, 9 aa, Artificial Sequence
  Description of Artificial Sequence: Synthetic peptide
QQYNNRPLT

SEQ ID NO: 705 - DNA, 354 bp, Artificial Sequence; identical to SEQ ID NO: 689
  Description of Artificial Sequence: Synthetic polynucleotide

SEQ ID NO: 706 - protein, 118 aa, Artificial Sequence; identical to SEQ ID NO: 610
  Description of Artificial Sequence: Synthetic polypeptide

SEQ ID NO: 707 - DNA, 24 bp, Artificial Sequence
  Description of Artificial Sequence: Synthetic oligonucleotide
ggtttcaccttcagaagttttggc

SEQ ID NO: 708 - protein, 8 aa, Artificial Sequence
  Description of Artificial Sequence: Synthetic peptide
GFTFRSFG

SEQ ID NO: 709 - DNA, 24 bp, Artificial Sequence
  Description of Artificial Sequence: Synthetic oligonucleotide
atatattttgatggaaaaaataaa

SEQ ID NO: 710 - protein, 8 aa, Artificial Sequence
  Description of Artificial Sequence: Synthetic peptide
IYFDGKNK

SEQ ID NO: 711 - DNA, 33 bp, Artificial Sequence; identical to SEQ ID NO: 551
  Description of Artificial Sequence: Synthetic oligonucleotide

SEQ ID NO: 712 - protein, 11 aa, Artificial Sequence
  Description of Artificial Sequence: Synthetic peptide
ARGPGYNWLDP

SEQ ID NO: 713 - DNA, 321 bp, Artificial Sequence
  Description of Artificial Sequence: Synthetic polynucleotide
gaaatagtgatgacgcagtctccagccaccctgtctgtgtctccaggggaaagagtcatcctctcctgtagggccagtcagagtattagcaggaacttggcctggtaccagcaraaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 714 - protein, 107 aa, Artificial Sequence
  Description of Artificial Sequence: Synthetic polypeptide
  MOD_RES (38)..(38): Any amino acid
EIVMTQSPATLSVSPGERVILSCRASQSISRNLAWYQXKPGQAPRLLIYGATTRATGVPARFSGSGSGTEFTLTISSLQSEDFAVFYCQQYNNRPLTFGGGTEVEIK

SEQ ID NO: 715 - DNA, 18 bp, Artificial Sequence
  Description of Artificial Sequence: Synthetic oligonucleotide
cagagtattagcaggaac

SEQ ID NO: 716 - protein, 6 aa, Artificial Sequence
  Description of Artificial Sequence: Synthetic peptide
QSISRN

SEQ ID NO: 717 - DNA, 9 bp, Artificial Sequence
  Description of Artificial Sequence: Synthetic oligonucleotide
ggtgcaacc

SEQ ID NO: 718 - protein, 3 aa, Artificial Sequence
  Description of Artificial Sequence: Synthetic peptide
GAT

SEQ ID NO: 719 - DNA, 27 bp, Artificial Sequence
  Description of Artificial Sequence: Synthetic oligonucleotide
cagcagtataataataggcctctcact

SEQ ID NO: 720 - protein, 9 aa, Artificial Sequence
  Description of Artificial Sequence: Synthetic peptide
QQYNNRPLT

SEQ ID NO: 721 - DNA, 354 bp, Artificial Sequence; identical to SEQ ID NO: 593
  Description of Artificial Sequence: Synthetic polynucleotide

SEQ ID NO: 722 - protein, 118 aa, Artificial Sequence; identical to SEQ ID NO: 594
  Description of Artificial Sequence: Synthetic polypeptide

SEQ ID NO: 723 - DNA, 24 bp, Artificial Sequence
  Description of Artificial Sequence: Synthetic oligonucleotide
ggatttaccttcagaagttatggc

SEQ ID NO: 724 - protein, 8 aa, Artificial Sequence
  Description of Artificial Sequence: Synthetic peptide
GFTFRSYG

SEQ ID NO: 725 - DNA, 24 bp, Artificial Sequence
  Description of Artificial Sequence: Synthetic oligonucleotide
atatattatgatggaaacaataaa

SEQ ID NO: 726 - protein, 8 aa, Artificial Sequence
  Description of Artificial Sequence: Synthetic peptide
IYYDGNNK

SEQ ID NO: 727 - DNA, 33 bp, Artificial Sequence; identical to SEQ ID NO: 551
  Description of Artificial Sequence: Synthetic oligonucleotide

SEQ ID NO: 728 - protein, 11 aa, Artificial Sequence
  Description of Artificial Sequence: Synthetic peptide
ARGPGYNWLDP

SEQ ID NO: 729 - DNA, 321 bp, Artificial Sequence; identical to SEQ ID NO: 601
  Description of Artificial Sequence: Synthetic polynucleotide

SEQ ID NO: 730 - protein, 107 aa, Artificial Sequence; identical to SEQ ID NO: 602
  Description of Artificial Sequence: Synthetic polypeptide

SEQ ID NO: 731 - DNA, 18 bp, Artificial Sequence
  Description of Artificial Sequence: Synthetic oligonucleotide
cagagtgttagcagcaac

SEQ ID NO: 732 - protein, 6 aa, Artificial Sequence
  Description of Artificial Sequence: Synthetic peptide
QSVSSN

SEQ ID NO: 733 - DNA, 9 bp, Artificial Sequence
  Description of Artificial Sequence: Synthetic oligonucleotide
ggtgcatcc

SEQ ID NO: 734 - protein, 3 aa, Artificial Sequence
  Description of Artificial Sequence: Synthetic peptide
GAS

SEQ ID NO: 735 - DNA, 27 bp, Artificial Sequence
  Description of Artificial Sequence: Synthetic oligonucleotide
cagcagtataataacaggcctctcact

SEQ ID NO: 736 - protein, 9 aa, Artificial Sequence
  Description of Artificial Sequence: Synthetic peptide
QQYNNRPLT

SEQ ID NO: 737 - DNA, 372 bp, Artificial Sequence
  Description of Artificial Sequence: Synthetic polynucleotide
gaagtgcagctggtggagtctgggggaggcttggtacagcctggcaggtccctgagactctcctgtgcagcctctggattcacctttgatgattattccatgcactgggtccggcaagctccagggaagggcctggagtgggtctcaggtattagttggaatagtcgtagcatagactatgcggactctgtgaagggccgattcaccatctccagagacaacgccaagaactccctgtatctgcaaatgaacagtctgagagctgaggacacggccttgtattactgtgtaaaagataatagtggctatggccgctattactactacgggatggacgtctggggccaagggaccacggtctccgtctcctca

SEQ ID NO: 738 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSRSIDYADSVKGRFTISRDNAKNSLYLQMNSLRAEDTALYYCVKDNSGYGRYYYYGMDVWGQGTTVSVSS

SEQ ID NO: 739 - DNA, 24 bp, Artificial Sequence
  Description of Artificial Sequence: Synthetic oligonucleotide
ggattcacctttgatgattattcc

SEQ ID NO: 740 - protein, 8 aa, Artificial Sequence
  Description of Artificial Sequence: Synthetic peptide
GFTFDDYS

SEQ ID NO: 741 - DNA, 24 bp, Artificial Sequence
  Description of Artificial Sequence: Synthetic oligonucleotide
attagttggaatagtcgtagcata

SEQ ID NO: 742 - protein, 8 aa, Artificial Sequence
  Description of Artificial Sequence: Synthetic peptide
ISWNSRSI

SEQ ID NO: 743 - DNA, 51 bp, Artificial Sequence
  Description of Artificial Sequence: Synthetic oligonucleotide
gtaaaagataatagtggctatggccgctattactactacgggatggacgtc

SEQ ID NO: 744 - protein, 17 aa, Artificial Sequence
  Description of Artificial Sequence: Synthetic peptide
VKDNSGYGRYYYYGMDV

SEQ ID NO: 745 - DNA, 321 bp, Artificial Sequence
  Description of Artificial Sequence: Synthetic polynucleotide
aaaatagtgatgacgcagtctcccgccaccctgtctgtgtctccaggggaaagagccaccctctcctgcagggccagtcagagtgttagcggcaacttagcctggtaccagcaaaaacctggccaggctcccaggctcctcatctatggtgcatccaccagggccactagtatcccagccaggttcagtggcagtgggtctgggacagagttcactctcaccatcagcagcctgcagtctgaagattttgcagtttatttctgtcagcactattataactggcctctcactttcggcggagggaccaaggtggagatcaga

SEQ ID NO: 746 - protein, 107 aa, Artificial Sequence
  Description of Artificial Sequence: Synthetic polypeptide
KIVMTQSPATLSVSPGERATLSCRASQSVSGNLAWYQQKPGQAPRLLIYGASTRATSIPARFSGSGSGTEFTLTISSLQSEDFAVYFCQHYYNWPLTFGGGTKVEIR

SEQ ID NO: 747 - DNA, 18 bp, Artificial Sequence
  Description of Artificial Sequence: Synthetic oligonucleotide
cagagtgttagcggcaac

SEQ ID NO: 748 - protein, 6 aa, Artificial Sequence
  Description of Artificial Sequence: Synthetic peptide
QSVSGN

SEQ ID NO: 749 - DNA, 9 bp, Artificial Sequence
  Description of Artificial Sequence: Synthetic oligonucleotide
ggtgcatcc

SEQ ID NO: 750 - protein, 3 aa, Artificial Sequence
  Description of Artificial Sequence: Synthetic peptide
GAS

SEQ ID NO: 751 - DNA, 27 bp, Artificial Sequence
  Description of Artificial Sequence: Synthetic oligonucleotide
cagcactattataactggcctctcact

SEQ ID NO: 752 - protein, 9 aa, Artificial Sequence
  Description of Artificial Sequence: Synthetic peptide
QHYYNWPLT

SEQ ID NO: 753 - DNA, 369 bp, Artificial Sequence; identical to SEQ ID NO: 401
  Description of Artificial Sequence: Synthetic polynucleotide

SEQ ID NO: 754 - protein, 123 aa, Artificial Sequence; identical to SEQ ID NO: 402
  Description of Artificial Sequence: Synthetic polypeptide

SEQ ID NO: 755 - DNA, 24 bp, Artificial Sequence
  Description of Artificial Sequence: Synthetic oligonucleotide
ggattcacctttgatgattttacc

SEQ ID NO: 756 - protein, 8 aa, Artificial Sequence
  Description of Artificial Sequence: Synthetic peptide
GFTFDDFT

SEQ ID NO: 757 - DNA, 24 bp, Artificial Sequence
  Description of Artificial Sequence: Synthetic oligonucleotide
atcagttggaatagtggtagcata

SEQ ID NO: 758 - protein, 8 aa, Artificial Sequence
  Description of Artificial Sequence: Synthetic peptide
ISWNSGSI

SEQ ID NO: 759 - DNA, 48 bp, Artificial Sequence; identical to SEQ ID NO: 407
  Description of Artificial Sequence: Synthetic oligonucleotide

SEQ ID NO: 760 - protein, 16 aa, Artificial Sequence
  Description of Artificial Sequence: Synthetic peptide
AKDNSGYGYYYYGMDV

SEQ ID NO: 761 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaa

SEQ ID NO: 762 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 763 - DNA, 36 bp, Artificial Sequence
  Description of Artificial Sequence: Synthetic oligonucleotide
cagagtgttttatacagctccaacaataagaactac

SEQ ID NO: 764 - protein, 12 aa, Artificial Sequence
  Description of Artificial Sequence: Synthetic peptide
QSVLYSSNNKNY

SEQ ID NO: 765 - DNA, 9 bp, Artificial Sequence
  Description of Artificial Sequence: Synthetic oligonucleotide
tgggcatct

SEQ ID NO: 766 - protein, 3 aa, Artificial Sequence
  Description of Artificial Sequence: Synthetic peptide
WAS

SEQ ID NO: 767 - DNA, 27 bp, Artificial Sequence
  Description of Artificial Sequence: Synthetic oligonucleotide
cagcaatattatagtactccgtacact

SEQ ID NO: 768 - protein, 9 aa, Artificial Sequence
  Description of Artificial Sequence: Synthetic peptide
QQYYSTPYT

SEQ ID NO: 769 - DNA, 369 bp, Artificial Sequence
  Description of Artificial Sequence: Synthetic polynucleotide
caggtcaccttgaaggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatggatatagtgggagctagaggggggtggttcgacccctggggccagggaaccctggtcaccgtctcctca

SEQ ID NO: 770 - protein, 123 aa, Artificial Sequence
  Description of Artificial Sequence: Synthetic polypeptide
QVTLKESGPALVKPTQTLTLTCTFSGFSLSTSGMCVSWIRQPPGKALEWLARIDWDDDKYYSTSLKTRLTISKDTSKNQVVLTMTNMDPVDTATYYCARMDIVGARGGWFDPWGQGTLVTVSS

SEQ ID NO: 771 - DNA, 30 bp, Artificial Sequence
  Description of Artificial Sequence: Synthetic oligonucleotide
gggttctcactcagcactagtggaatgtgt

SEQ ID NO: 772 - protein, 10 aa, Artificial Sequence
  Description of Artificial Sequence: Synthetic peptide
GFSLSTSGMC

SEQ ID NO: 773 - DNA, 21 bp, Artificial Sequence
  Description of Artificial Sequence: Synthetic oligonucleotide
attgattgggatgatgataaa

SEQ ID NO: 774 - protein, 7 aa, Artificial Sequence
  Description of Artificial Sequence: Synthetic peptide
IDWDDDK

SEQ ID NO: 775 - DNA, 45 bp, Artificial Sequence
  Description of Artificial Sequence: Synthetic oligonucleotide
gcacggatggatatagtgggagctagaggggggtggttcgacccc

SEQ ID NO: 776 - protein, 15 aa, Artificial Sequence
  Description of Artificial Sequence: Synthetic peptide
ARMDIVGARGGWFDP

SEQ ID NO: 777 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgctcactttcggcggagggaccaaggtggagatcaaa

SEQ ID NO: 778 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIK

SEQ ID NO: 779 - DNA, 18 bp, Artificial Sequence
  Description of Artificial Sequence: Synthetic oligonucleotide
cagggcattagcaattat

SEQ ID NO: 780 - protein, 6 aa, Artificial Sequence
  Description of Artificial Sequence: Synthetic peptide
QGISNY

SEQ ID NO: 781 - DNA, 9 bp, Artificial Sequence
  Description of Artificial Sequence: Synthetic oligonucleotide
gctgcatcc

SEQ ID NO: 782 - protein, 3 aa, Artificial Sequence
  Description of Artificial Sequence: Synthetic peptide
AAS

SEQ ID NO: 783 - DNA, 27 bp, Artificial Sequence
  Description of Artificial Sequence: Synthetic oligonucleotide
caacagtataatagttacccgctcact

SEQ ID NO: 784 - protein, 9 aa, Artificial Sequence
  Description of Artificial Sequence: Synthetic peptide
QQYNSYPLT

SEQ ID NO: 785 - DNA, 404 bp, Artificial Sequence
  Description of Artificial Sequence: Synthetic polynucleotide
caggtgcagttggtggagtctgggggaggcgtggtccagcctgggaggtccctgagactctcctgtgctgcgtctggattcaccttcagaagttatggcatgcactgggtccgccaggctccaggcaaggggctggagtgggtggcaatgatatattatgatggaaataataaaaagtatgcagactccgtgaggggccgattcaccatttccagagacaattccaagaacacgctgtatctgcaaatgaacagcctgagagtcgaggacacggctgtgtatttctgtgcgcgagggcctgggtacaactggctcgacccctggggccagggaaccctggtcaccgtctcctcagccaaaacaacagccccacccgtttatccactggcccctggaagcttggg

SEQ ID NO: 786 - protein, 134 aa, Artificial Sequence
  Description of Artificial Sequence: Synthetic polypeptide
QVQLVESGGGVVQPGRSLRLSCAASGFTFRSYGMHWVRQAPGKGLEWVAMIYYDGNNKKYADSVRGRFTISRDNSKNTLYLQMNSLRVEDTAVYFCARGPGYNWLDPWGQGTLVTVSSAKTTAPPVYPLAPGSL

SEQ ID NO: 787 - DNA, 24 bp, Artificial Sequence
  Description of Artificial Sequence: Synthetic oligonucleotide
ggattcaccttcagaagttatggc

SEQ ID NO: 788 - protein, 8 aa, Artificial Sequence
  Description of Artificial Sequence: Synthetic peptide
GFTFRSYG

SEQ ID NO: 789 - DNA, 24 bp, Artificial Sequence
  Description of Artificial Sequence: Synthetic oligonucleotide
atatattatgatggaaataataaa

SEQ ID NO: 790 - protein, 8 aa, Artificial Sequence
  Description of Artificial Sequence: Synthetic peptide
IYYDGNNK

SEQ ID NO: 791 - DNA, 33 bp, Artificial Sequence; identical to SEQ ID NO: 551
  Description of Artificial Sequence: Synthetic oligonucleotide

SEQ ID NO: 792 - protein, 11 aa, Artificial Sequence
  Description of Artificial Sequence: Synthetic peptide
ARGPGYNWLDP

SEQ ID NO: 793 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcaggaacttggcctggtaccagcagaaacctggccaggctcccaggctcctcatctatggtgcatccaccagggccactgatatcccagccaggttcagtggcagtgggtctgggacagagttcattctcaacatcagcagcctgcagtctgaagattttgcactttattactgtcaacaatatagtaactggcctctcactttcggcggagggaccgaggtggagatcaaa

SEQ ID NO: 794 - protein, 107 aa, Artificial Sequence
  Description of Artificial Sequence: Synthetic polypeptide
EIVMTQSPATLSVSPGERATLSCRASQSVSRNLAWYQQKPGQAPRLLIYGASTRATDIPARFSGSGSGTEFILNISSLQSEDFALYYCQQYSNWPLTFGGGTEVEIK

SEQ ID NO: 795 - DNA, 18 bp, Artificial Sequence
  Description of Artificial Sequence: Synthetic oligonucleotide
cagagtgttagcaggaac

SEQ ID NO: 796 - protein, 6 aa, Artificial Sequence
  Description of Artificial Sequence: Synthetic peptide
QSVSRN

SEQ ID NO: 797 - DNA, 9 bp, Artificial Sequence
  Description of Artificial Sequence: Synthetic oligonucleotide
ggtgcatcc

SEQ ID NO: 798 - protein, 3 aa, Artificial Sequence
  Description of Artificial Sequence: Synthetic peptide
GAS

SEQ ID NO: 799 - DNA, 27 bp, Artificial Sequence
  Description of Artificial Sequence: Synthetic oligonucleotide
caacaatatagtaactggcctctcact

SEQ ID NO: 800 - protein, 9 aa, Artificial Sequence
  Description of Artificial Sequence: Synthetic peptide
QQYSNWPLT

SEQ ID NO: 801 - DNA, 354 bp, Artificial Sequence; identical to SEQ ID NO: 689
  Description of Artificial Sequence: Synthetic polynucleotide

SEQ ID NO: 802 - protein, 118 aa, Artificial Sequence; identical to SEQ ID NO: 610
  Description of Artificial Sequence: Synthetic polypeptide

SEQ ID NO: 803 - DNA, 24 bp, Artificial Sequence
  Description of Artificial Sequence: Synthetic oligonucleotide
ggtttcaccttcagaagttttggc

SEQ ID NO: 804 - protein, 8 aa, Artificial Sequence
  Description of Artificial Sequence: Synthetic peptide
GFTFRSFG

SEQ ID NO: 805 - DNA, 24 bp, Artificial Sequence
  Description of Artificial Sequence: Synthetic oligonucleotide
atatattttgatggaaaaaataaa

SEQ ID NO: 806 - protein, 8 aa, Artificial Sequence
  Description of Artificial Sequence: Synthetic peptide
IYFDGKNK

SEQ ID NO: 807 - DNA, 33 bp, Artificial Sequence; identical to SEQ ID NO: 551
  Description of Artificial Sequence: Synthetic oligonucleotide

SEQ ID NO: 808 - protein, 11 aa, Artificial Sequence
  Description of Artificial Sequence: Synthetic peptide
ARGPGYNWLDP

SEQ ID NO: 809 - DNA, 321 bp, Artificial Sequence
  Description of Artificial Sequence: Synthetic polynucleotide
gaaatagtgatgacgcagtctccagccaccctgtctgtgtctccaggggaaagagtcatcctctcctgtagggccagtcagagtattagcaggaacttggcctggtaccagcagaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 810 - protein, 107 aa, Artificial Sequence; identical to SEQ ID NO: 698
  Description of Artificial Sequence: Synthetic polypeptide

SEQ ID NO: 811 - DNA, 18 bp, Artificial Sequence
  Description of Artificial Sequence: Synthetic oligonucleotide
cagagtattagcaggaac

SEQ ID NO: 812 - protein, 6 aa, Artificial Sequence
  Description of Artificial Sequence: Synthetic peptide
QSISRN

SEQ ID NO: 813 - DNA, 9 bp, Artificial Sequence
  Description of Artificial Sequence: Synthetic oligonucleotide
ggtgcaacc

SEQ ID NO: 814 - protein, 3 aa, Artificial Sequence
  Description of Artificial Sequence: Synthetic peptide
GAT

SEQ ID NO: 815 - DNA, 27 bp, Artificial Sequence
  Description of Artificial Sequence: Synthetic oligonucleotide
cagcagtataataataggcctctcact

SEQ ID NO: 816 - protein, 9 aa, Artificial Sequence
  Description of Artificial Sequence: Synthetic peptide
QQYNNRPLT

SEQ ID NO: 817 - DNA, 354 bp, Artificial Sequence; identical to SEQ ID NO: 689
  Description of Artificial Sequence: Synthetic polynucleotide

SEQ ID NO: 818 - protein, 118 aa, Artificial Sequence; identical to SEQ ID NO: 610
  Description of Artificial Sequence: Synthetic polypeptide

SEQ ID NO: 819 - DNA, 24 bp, Artificial Sequence
  Description of Artificial Sequence: Synthetic oligonucleotide
ggtttcaccttcagaagttttggc

SEQ ID NO: 820 - protein, 8 aa, Artificial Sequence
  Description of Artificial Sequence: Synthetic peptide
GFTFRSFG

SEQ ID NO: 821 - DNA, 24 bp, Artificial Sequence
  Description of Artificial Sequence: Synthetic oligonucleotide
atatattttgatggaaaaaataaa

SEQ ID NO: 822 - protein, 8 aa, Artificial Sequence
  Description of Artificial Sequence: Synthetic peptide
IYFDGKNK

SEQ ID NO: 823 - DNA, 33 bp, Artificial Sequence; identical to SEQ ID NO: 551
  Description of Artificial Sequence: Synthetic oligonucleotide

SEQ ID NO: 824 - protein, 11 aa, Artificial Sequence
  Description of Artificial Sequence: Synthetic peptide
ARGPGYNWLDP

SEQ ID NO: 825 - DNA, 321 bp, Artificial Sequence; identical to SEQ ID NO: 809
  Description of Artificial Sequence: Synthetic polynucleotide

SEQ ID NO: 826 - protein, 107 aa, Artificial Sequence; identical to SEQ ID NO: 698
  Description of Artificial Sequence: Synthetic polypeptide

SEQ ID NO: 827 - DNA, 18 bp, Artificial Sequence
  Description of Artificial Sequence: Synthetic oligonucleotide
cagagtattagcaggaac

SEQ ID NO: 828 - protein, 6 aa, Artificial Sequence
  Description of Artificial Sequence: Synthetic peptide
QSISRN

SEQ ID NO: 829 - DNA, 9 bp, Artificial Sequence
  Description of Artificial Sequence: Synthetic oligonucleotide
ggtgcaacc

SEQ ID NO: 830 - protein, 3 aa, Artificial Sequence
  Description of Artificial Sequence: Synthetic peptide
GAT

SEQ ID NO: 831 - DNA, 27 bp, Artificial Sequence
  Description of Artificial Sequence: Synthetic oligonucleotide
cagcagtataataataggcctctcact

SEQ ID NO: 832 - protein, 9 aa, Artificial Sequence
  Description of Artificial Sequence: Synthetic peptide
QQYNNRPLT

SEQ ID NO: 833 - DNA, 351 bp, Artificial Sequence
  Description of Artificial Sequence: Synthetic polynucleotide
caggtgcacctggaagagtctgggggaggcgtggtccagcctgggaggtccctgagactctcctgttcagcgtctggtttcaccttcagtagttatgccatgcactgggtccgccaggctccaggcaaggggctggagtgggtggcagttatatggtatgatggaactaataaatattatttagattccgtgaagggccgattcaccatctccagagacaattccaagaacacgctgtttctgcaaatgaacagcctgagagccgaagacacggctgtgtattactgtgcgagagatcggggaagtataataacccactggggccagggaaccctggtcaccgtctcctca

SEQ ID NO: 834 - protein, 117 aa, Artificial Sequence
  Description of Artificial Sequence: Synthetic polypeptide
QVHLEESGGGVVQPGRSLRLSCSASGFTFSSYAMHWVRQAPGKGLEWVAVIWYDGTNKYYLDSVKGRFTISRDNSKNTLFLQMNSLRAEDTAVYYCARDRGSIITHWGQGTLVTVSS

SEQ ID NO: 835 - DNA, 24 bp, Artificial Sequence
  Description of Artificial Sequence: Synthetic oligonucleotide
ggtttcaccttcagtagttatgcc

SEQ ID NO: 836 - protein, 8 aa, Artificial Sequence
  Description of Artificial Sequence: Synthetic peptide
GFTFSSYA

SEQ ID NO: 837 - DNA, 24 bp, Artificial Sequence
  Description of Artificial Sequence: Synthetic oligonucleotide
atatggtatgatggaactaataaa

SEQ ID NO: 838 - protein, 8 aa, Artificial Sequence
  Description of Artificial Sequence: Synthetic peptide
IWYDGTNK

SEQ ID NO: 839 - DNA, 30 bp, Artificial Sequence
  Description of Artificial Sequence: Synthetic oligonucleotide
gcgagagatcggggaagtataataacccac

SEQ ID NO: 840 - protein, 10 aa, Artificial Sequence
  Description of Artificial Sequence: Synthetic peptide
ARDRGSIITH

SEQ ID NO: 841 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcagaacattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagacttacagtacccctccgatcaccttcggccaagggacacgactggagattaaa

SEQ ID NO: 842 - protein, 108 aa, Artificial Sequence
  Description of Artificial Sequence: Synthetic polypeptide
DIQMTQSPSSLSASIGDRVTITCRASQNISSYLNWYQQKPGKAPKLLIYAASSLQSGVPSRFSGSGSGTDFTLTISSLQPEDFATYYCQQTYSTPPITFGQGTRLEIK

SEQ ID NO: 843 - DNA, 18 bp, Artificial Sequence
  Description of Artificial Sequence: Synthetic oligonucleotide
cagaacattagcagctat

SEQ ID NO: 844 - protein, 6 aa, Artificial Sequence
  Description of Artificial Sequence: Synthetic peptide
QNISSY

SEQ ID NO: 845 - DNA, 9 bp, Artificial Sequence
  Description of Artificial Sequence: Synthetic oligonucleotide
gctgcatcc

SEQ ID NO: 846 - protein, 3 aa, Artificial Sequence
  Description of Artificial Sequence: Synthetic peptide
AAS

SEQ ID NO: 847 - DNA, 30 bp, Artificial Sequence
  Description of Artificial Sequence: Synthetic oligonucleotide
caacagacttacagtacccctccgatcacc

SEQ ID NO: 848 - protein, 10 aa, Artificial Sequence
  Description of Artificial Sequence: Synthetic peptide
QQTYSTPPIT

SEQ ID NO: 849 - DNA, 372 bp, Artificial Sequence
  Description of Artificial Sequence: Synthetic polynucleotide
gaagtacagctggtggagtctgggggaggcttggtacggcctggcaggtccctgagactctcctgtgcagcctctggattcacctttgatgattataccatgcactgggtccgccaagctccagggaagggcctggagtgggtctcagatattagttggaatagtgggaccataggctatgcggactctgtgaagggccgattcaccatctccagagacaacgccaagaactccctgtatctgcaaatgaacagtctgagacctgaggacacggccttgtattactgtgcaaaagatatgagtggctacgcccactactactactacggtatggacgtctggggccaagggaccacggtcaccgtctcctca

SEQ ID NO: 850 - protein, 124 aa, Artificial Sequence
  Description of Artificial Sequence: Synthetic polypeptide
EVQLVESGGGLVRPGRSLRLSCAASGFTFDDYTMHWVRQAPGKGLEWVSDISWNSGTIGYADSVKGRFTISRDNAKNSLYLQMNSLRPEDTALYYCAKDMSGYAHYYYYGMDVWGQGTTVTVSS

SEQ ID NO: 851 - DNA, 24 bp, Artificial Sequence
  Description of Artificial Sequence: Synthetic oligonucleotide
ggattcacctttgatgattatacc

SEQ ID NO: 852 - protein, 8 aa, Artificial Sequence
  Description of Artificial Sequence: Synthetic peptide
GFTFDDYT

SEQ ID NO: 853 - DNA, 24 bp, Artificial Sequence
  Description of Artificial Sequence: Synthetic oligonucleotide
attagttggaatagtgggaccata

SEQ ID NO: 854 - protein, 8 aa, Artificial Sequence
  Description of Artificial Sequence: Synthetic peptide
ISWNSGTI

SEQ ID NO: 855 - DNA, 51 bp, Artificial Sequence
  Description of Artificial Sequence: Synthetic oligonucleotide
gcaaaagatatgagtggctacgcccactactactactacggtatggacgtc

SEQ ID NO: 856 - protein, 17 aa, Artificial Sequence
  Description of Artificial Sequence: Synthetic peptide
AKDMSGYAHYYYYGMDV

SEQ ID NO: 857 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 858 - protein, 108 aa, Artificial Sequence; identical to SEQ ID NO: 58
  Description of Artificial Sequence: Synthetic polypeptide

SEQ ID NO: 859 - DNA, 18 bp, Artificial Sequence
  Description of Artificial Sequence: Synthetic oligonucleotide
cagagcattagcagctat

SEQ ID NO: 860 - protein, 6 aa, Artificial Sequence
  Description of Artificial Sequence: Synthetic peptide
QSISSY

SEQ ID NO: 861 - DNA, 9 bp, Artificial Sequence
  Description of Artificial Sequence: Synthetic oligonucleotide
gctgcatcc

SEQ ID NO: 862 - protein, 3 aa, Artificial Sequence
  Description of Artificial Sequence: Synthetic peptide
AAS

SEQ ID NO: 863 - DNA, 30 bp, Artificial Sequence; identical to SEQ ID NO: 15
  Description of Artificial Sequence: Synthetic oligonucleotide

SEQ ID NO: 864 - protein, 10 aa, Artificial Sequence
  Description of Artificial Sequence: Synthetic peptide
QQSYSTPPIT

SEQ ID NO: 865 - DNA, 372 bp, Artificial Sequence
  Description of Artificial Sequence: Synthetic polynucleotide
gaagtgcagctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccctgtattactgtgcaaaagatatgagtggctacgcccactacggctactacggtatggacgtctggggccaagggaccacggtcaccgtctcctca

SEQ ID NO: 866 - protein, 124 aa, Artificial Sequence
  Description of Artificial Sequence: Synthetic polypeptide
EVQLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYAHYGYYGMDVWGQGTTVTVSS

SEQ ID NO: 867 - DNA, 24 bp, Artificial Sequence
  Description of Artificial Sequence: Synthetic oligonucleotide
ggattcacctttgatgattatacc

SEQ ID NO: 868 - protein, 8 aa, Artificial Sequence
  Description of Artificial Sequence: Synthetic peptide
GFTFDDYT

SEQ ID NO: 869 - DNA, 24 bp, Artificial Sequence
  Description of Artificial Sequence: Synthetic oligonucleotide
attagttggaatagtggtagcata

SEQ ID NO: 870 - protein, 8 aa, Artificial Sequence
  Description of Artificial Sequence: Synthetic peptide
ISWNSGSI

SEQ ID NO: 871 - DNA, 51 bp, Artificial Sequence
  Description of Artificial Sequence: Synthetic oligonucleotide
gcaaaagatatgagtggctacgcccactacggctactacggtatggacgtc

SEQ ID NO: 872 - protein, 17 aa, Artificial Sequence
  Description of Artificial Sequence: Synthetic peptide
AKDMSGYAHYGYYGMDV

SEQ ID NO: 873 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattaggaactatttaaattggtatcagcagaaaccagggaaagtccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccctccgatcaccttcggccaagggacacgactggagattaaa

SEQ ID NO: 874 - protein, 108 aa, Artificial Sequence
  Description of Artificial Sequence: Synthetic polypeptide
DIQMTQSPSSLSASVGDRVTITCRASQSIRNYLNWYQQKPGKVPKLLIYAASSLQSGVPSRFSGSGSGTDFTLTISSLQPEDFATYYCQQSYSNPPITFGQGTRLEIK

SEQ ID NO: 875 - DNA, 18 bp, Artificial Sequence
  Description of Artificial Sequence: Synthetic oligonucleotide
cagagcattaggaactat

SEQ ID NO: 876 - protein, 6 aa, Artificial Sequence
  Description of Artificial Sequence: Synthetic peptide
QSIRNY

SEQ ID NO: 877 - DNA, 9 bp, Artificial Sequence
  Description of Artificial Sequence: Synthetic oligonucleotide
gctgcatcc

SEQ ID NO: 878 - protein, 3 aa, Artificial Sequence
  Description of Artificial Sequence: Synthetic peptide
AAS

SEQ ID NO: 879 - DNA, 30 bp, Artificial Sequence
  Description of Artificial Sequence: Synthetic oligonucleotide
caacagagttacagtaaccctccgatcacc

SEQ ID NO: 880 - protein, 10 aa, Artificial Sequence
  Description of Artificial Sequence: Synthetic peptide
QQSYSNPPIT

SEQ ID NO: 881 - DNA, 369 bp, Artificial Sequence
  Description of Artificial Sequence: Synthetic polynucleotide
gaagcgcagctggtggaatctgggggaggcttggtacagcctggcaggtccctgagactctcctgtacaacctctggattcacctttgatgattataccatgcactgggtccggcaagctccagggaagggcctggagtggatctctgatattagttggaatggtggaaccaaaggctatgcggactctgtgaagggccgattcaccatctccagagacaacgccaaaaactccctgtatctgcaaatggacagtctgagaggtgaggacacggccttatattactgtgtaaaagataaaagtggctacgggcacttctacttcggtttggacgtctggggccaagggaccacggtcaccgtctcctca

SEQ ID NO: 882 - protein, 123 aa, Artificial Sequence
  Description of Artificial Sequence: Synthetic polypeptide
EAQLVESGGGLVQPGRSLRLSCTTSGFTFDDYTMHWVRQAPGKGLEWISDISWNGGTKGYADSVKGRFTISRDNAKNSLYLQMDSLRGEDTALYYCVKDKSGYGHFYFGLDVWGQGTTVTVSS

SEQ ID NO: 883 - DNA, 24 bp, Artificial Sequence
  Description of Artificial Sequence: Synthetic oligonucleotide
ggattcacctttgatgattatacc

SEQ ID NO: 884 - protein, 8 aa, Artificial Sequence
  Description of Artificial Sequence: Synthetic peptide
GFTFDDYT

SEQ ID NO: 885 - DNA, 24 bp, Artificial Sequence
  Description of Artificial Sequence: Synthetic oligonucleotide
attagttggaatggtggaaccaaa

SEQ ID NO: 886 - protein, 8 aa, Artificial Sequence
  Description of Artificial Sequence: Synthetic peptide
ISWNGGTK

SEQ ID NO: 887 - DNA, 48 bp, Artificial Sequence
  Description of Artificial Sequence: Synthetic oligonucleotide
gtaaaagataaaagtggctacgggcacttctacttcggtttggacgtc

SEQ ID NO: 888 - protein, 16 aa, Artificial Sequence
  Description of Artificial Sequence: Synthetic peptide
VKDKSGYGHFYFGLDV

SEQ ID NO: 889 - DNA, 324 bp, Artificial Sequence
  Description of Artificial Sequence: Synthetic polynucleotide
gacatccagatgacccagtctccatcctccctgactgcgtctgtaggagacagagtcaccttcacttgccgggcaagtcagagcattagcaggcatttaagttggtatcagcagaaaccagggaaagcccctaagctcctgatctatgctgcatccagtttggaaagtggggtcccttcaaggttcagtggcagtggatctgggacagatttcactctcaccatcagcagtctgcaccctgaagattttgcaacttactactgtcaacagagctacagtaaccctccgatcaccttcggccaagggacacgactggagattaaa

SEQ ID NO: 890 - protein, 108 aa, Artificial Sequence
  Description of Artificial Sequence: Synthetic polypeptide
DIQMTQSPSSLTASVGDRVTFTCRASQSISRHLSWYQQKPGKAPKLLIYAASSLESGVPSRFSGSGSGTDFTLTISSLHPEDFATYYCQQSYSNPPITFGQGTRLEIK

SEQ ID NO: 891 - DNA, 18 bp, Artificial Sequence
  Description of Artificial Sequence: Synthetic oligonucleotide
cagagcattagcaggcat

SEQ ID NO: 892 - protein, 6 aa, Artificial Sequence
  Description of Artificial Sequence: Synthetic peptide
QSISRH

SEQ ID NO: 893 - DNA, 9 bp, Artificial Sequence
  Description of Artificial Sequence: Synthetic oligonucleotide
gctgcatcc

SEQ ID NO: 894 - protein, 3 aa, Artificial Sequence
  Description of Artificial Sequence: Synthetic peptide
AAS

SEQ ID NO: 895 - DNA, 30 bp, Artificial Sequence
  Description of Artificial Sequence: Synthetic oligonucleotide
caacagagctacagtaaccctccgatcacc

SEQ ID NO: 896 - protein, 10 aa, Artificial Sequence
  Description of Artificial Sequence: Synthetic peptide
QQSYSNPPIT

SEQ ID NO: 897 - DNA, 369 bp, Artificial Sequence
  Description of Artificial Sequence: Synthetic polynucleotide
gaagtgcagttggtggagtctgggggaggcttggtacagcctggcaggtccctgagactctcctgtgcagcctctggattcaagtttgctgattatgccatgcactgggtccggcaagctccagggaagggcctggagtgggtctcagagattagttggaatagtggtagcataggttatgtggactctgtgaagggccgattcaccatctccagagacaacgccaagaactccctgtatctgcaaatgaacagtctgagagctgaggacacggccttgtattactgtgtaaaagataaaagtggctacgggcactactatatcggtatggacgtctggggccaagggaccacggtcatcgtctcctcc

SEQ ID NO: 898 - protein, 123 aa, Artificial Sequence
  Description of Artificial Sequence: Synthetic polypeptide
EVQLVESGGGLVQPGRSLRLSCAASGFKFADYAMHWVRQAPGKGLEWVSEISWNSGSIGYVDSVKGRFTISRDNAKNSLYLQMNSLRAEDTALYYCVKDKSGYGHYYIGMDVWGQGTTVIVSS

SEQ ID NO: 899 - DNA, 24 bp, Artificial Sequence
  Description of Artificial Sequence: Synthetic oligonucleotide
ggattcaagtttgctgattatgcc

SEQ ID NO: 900 - protein, 8 aa, Artificial Sequence
  Description of Artificial Sequence: Synthetic peptide
GFKFADYA

SEQ ID NO: 901 - DNA, 24 bp, Artificial Sequence
  Description of Artificial Sequence: Synthetic oligonucleotide
attagttggaatagtggtagcata

SEQ ID NO: 902 - protein, 8 aa, Artificial Sequence
  Description of Artificial Sequence: Synthetic peptide
ISWNSGSI

SEQ ID NO: 903 - DNA, 48 bp, Artificial Sequence
  Description of Artificial Sequence: Synthetic oligonucleotide
gtaaaagataaaagtggctacgggcactactatatcggtatggacgtc

SEQ ID NO: 904 - protein, 16 aa, Artificial Sequence
  Description of Artificial Sequence: Synthetic peptide
VKDKSGYGHYYIGMDV

SEQ ID NO: 905 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagtattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 906 - protein, 108 aa, Artificial Sequence; identical to SEQ ID NO: 58
  Description of Artificial Sequence: Synthetic polypeptide

SEQ ID NO: 907 - DNA, 18 bp, Artificial Sequence
  Description of Artificial Sequence: Synthetic oligonucleotide
cagagtattagcagctat

SEQ ID NO: 908 - protein, 6 aa, Artificial Sequence
  Description of Artificial Sequence: Synthetic peptide
QSISSY

SEQ ID NO: 909 - DNA, 9 bp, Artificial Sequence
  Description of Artificial Sequence: Synthetic oligonucleotide
gctgcatcc

SEQ ID NO: 910 - protein, 3 aa, Artificial Sequence
  Description of Artificial Sequence: Synthetic peptide
AAS

SEQ ID NO: 911 - DNA, 30 bp, Artificial Sequence; identical to SEQ ID NO: 15
  Description of Artificial Sequence: Synthetic oligonucleotide

SEQ ID NO: 912 - protein, 10 aa, Artificial Sequence
  Description of Artificial Sequence: Synthetic peptide
QQSYSTPPIT

SEQ ID NO: 913 - DNA, 372 bp, Artificial Sequence
  Description of Artificial Sequence: Synthetic polynucleotide
gaagtgcacctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccttgtattactgtgcaaaagatatgagtggctacggccactacggcaagtacggtatggacgtctggggccaagggaccacggtcaccgtctcctca

SEQ ID NO: 914 - protein, 124 aa, Artificial Sequence
  Description of Artificial Sequence: Synthetic polypeptide
EVHLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYGHYGKYGMDVWGQGTTVTVSS

SEQ ID NO: 915 - DNA, 24 bp, Artificial Sequence
  Description of Artificial Sequence: Synthetic oligonucleotide
ggattcacctttgatgattatacc

SEQ ID NO: 916 - protein, 8 aa, Artificial Sequence
  Description of Artificial Sequence: Synthetic peptide
GFTFDDYT

SEQ ID NO: 917 - DNA, 24 bp, Artificial Sequence
  Description of Artificial Sequence: Synthetic oligonucleotide
attagttggaatagtggtagcata

SEQ ID NO: 918 - protein, 8 aa, Artificial Sequence
  Description of Artificial Sequence: Synthetic peptide
ISWNSGSI

SEQ ID NO: 919 - DNA, 51 bp, Artificial Sequence
  Description of Artificial Sequence: Synthetic oligonucleotide
gcaaaagatatgagtggctacggccactacggcaagtacggtatggacgtc

SEQ ID NO: 920 - protein, 17 aa, Artificial Sequence
  Description of Artificial Sequence: Synthetic peptide
AKDMSGYGHYGKYGMDV

SEQ ID NO: 921 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattaggagctatttaaattggtatcagcagaaaccagggaaagtccctaagctcctgatctatgctgcatccagtttgcaaagtggggtcccatcaaggttcagtggcagtggatctgggacagatttcactctcaccatcaacagtctgcaacctgacgattttgcaacttactactgtcaacagacttacagtaaccctccgatcaccttcggccaagggacacgactggagattaaa

SEQ ID NO: 922 - protein, 108 aa, Artificial Sequence
  Description of Artificial Sequence: Synthetic polypeptide
DIQMTQSPSSLSASVGDRVTITCRASQSIRSYLNWYQQKPGKVPKLLIYAASSLQSGVPSRFSGSGSGTDFTLTINSLQPDDFATYYCQQTYSNPPITFGQGTRLEIK

SEQ ID NO: 923 - DNA, 18 bp, Artificial Sequence
  Description of Artificial Sequence: Synthetic oligonucleotide
cagagcattaggagctat

SEQ ID NO: 924 - protein, 6 aa, Artificial Sequence
  Description of Artificial Sequence: Synthetic peptide
QSIRSY

SEQ ID NO: 925 - DNA, 9 bp, Artificial Sequence
  Description of Artificial Sequence: Synthetic oligonucleotide
gctgcatcc

SEQ ID NO: 926 - protein, 3 aa, Artificial Sequence
  Description of Artificial Sequence: Synthetic peptide
AAS

SEQ ID NO: 927 - DNA, 30 bp, Artificial Sequence
  Description of Artificial Sequence: Synthetic oligonucleotide
caacagacttacagtaaccctccgatcacc

SEQ ID NO: 928 - protein, 10 aa, Artificial Sequence
  Description of Artificial Sequence: Synthetic peptide
QQTYSNPPIT

SEQ ID NO: 929 - DNA, 372 bp, Artificial Sequence
  Description of Artificial Sequence: Synthetic polynucleotide
gaggtgcagctggtggagtctgggggagacttggtacagcctggcaggtccctgagactctcctgtgcagcctctggattcacctttgatgattataccatgcactgggtccggcaagctccagggaagggcctggagtgggtctcaattattagttggaatggtaataccattgactatgcggactctgtgaagggccgattcaccatctccagagacaacgccaagaactccctgtatcttcaaatgaacagtctgagagctgaggacacggccttgtattactgtgcaaaagataagagtggctacggacacttctactattacgttttggacgtctggggccaagggaccacggtcaccgtctcctca

SEQ ID NO: 930 - protein, 124 aa, Artificial Sequence
  Description of Artificial Sequence: Synthetic polypeptide
EVQLVESGGDLVQPGRSLRLSCAASGFTFDDYTMHWVRQAPGKGLEWVSIISWNGNTIDYADSVKGRFTISRDNAKNSLYLQMNSLRAEDTALYYCAKDKSGYGHFYYYVLDVWGQGTTVTVSS

SEQ ID NO: 931 - DNA, 24 bp, Artificial Sequence
  Description of Artificial Sequence: Synthetic oligonucleotide
ggattcacctttgatgattatacc

SEQ ID NO: 932 - protein, 8 aa, Artificial Sequence
  Description of Artificial Sequence: Synthetic peptide
GFTFDDYT

SEQ ID NO: 933 - DNA, 24 bp, Artificial Sequence
  Description of Artificial Sequence: Synthetic oligonucleotide
attagttggaatggtaataccatt

SEQ ID NO: 934 - protein, 8 aa, Artificial Sequence
  Description of Artificial Sequence: Synthetic peptide
ISWNGNTI

SEQ ID NO: 935 - DNA, 51 bp, Artificial Sequence
  Description of Artificial Sequence: Synthetic oligonucleotide
gcaaaagataagagtggctacggacacttctactattacgttttggacgtc

SEQ ID NO: 936 - protein, 17 aa, Artificial Sequence
  Description of Artificial Sequence: Synthetic peptide
AKDKSGYGHFYYYVLDV

SEQ ID NO: 937 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattaacaactatttaaattggtatcagcagaaaccagggaaagcccctaaactcctgatctatgctgcttccagtttgcaaagtggggtcccgtcaaggttcagtggcagtggttctgggacagatttcactctcaccatcagcagtctgcaacctgaagattttgcaacttactactctcaacagagttacagtttcccgtggacgttcggccaagggaccaaggtggaaatcaaa

SEQ ID NO: 938 - protein, 107 aa, Artificial Sequence
  Description of Artificial Sequence: Synthetic polypeptide
DIQMTQSPSSLSASVGDRVTITCRASQSINNYLNWYQQKPGKAPKLLIYAASSLQSGVPSRFSGSGSGTDFTLTISSLQPEDFATYYSQQSYSFPWTFGQGTKVEIK

SEQ ID NO: 939 - DNA, 18 bp, Artificial Sequence
  Description of Artificial Sequence: Synthetic oligonucleotide
cagagcattaacaactat

SEQ ID NO: 940 - protein, 6 aa, Artificial Sequence
  Description of Artificial Sequence: Synthetic peptide
QSINNY

SEQ ID NO: 941 - DNA, 9 bp, Artificial Sequence
  Description of Artificial Sequence: Synthetic oligonucleotide
gctgcttcc

SEQ ID NO: 942 - protein, 3 aa, Artificial Sequence
  Description of Artificial Sequence: Synthetic peptide
AAS

SEQ ID NO: 943 - DNA, 27 bp, Artificial Sequence
  Description of Artificial Sequence: Synthetic oligonucleotide
caacagagttacagtttcccgtggacg

SEQ ID NO: 944 - protein, 9 aa, Artificial Sequence
  Description of Artificial Sequence: Synthetic peptide
QQSYSFPWT

SEQ ID NO: 945 - DNA, 363 bp, Artificial Sequence
  Description of Artificial Sequence: Synthetic polynucleotide
caggtgcagctggtggagtcggggggaggcgtggtccagcctgggaggtccctgagaccctcctgtgcagcgtctggatttagtttcagggactatggcatgcactgggtccgccaggctccaggtaagggactagagtggatggcacacatatggtataatggaaagaataaatattatgcagactccgtgaagggccgattcaccatctccagagacaattccaagaacacgctatatctgcaaatgaacagcctgagacccgaggacacggctgtatattattgtgcgagagatggtgtatcagcacgtggtactccatttgactactggggccagggaaccctggtcaccgtctcctca

SEQ ID NO: 946 - protein, 121 aa, Artificial Sequence
  Description of Artificial Sequence: Synthetic polypeptide
QVQLVESGGGVVQPGRSLRPSCAASGFSFRDYGMHWVRQAPGKGLEWMAHIWYNGKNKYYADSVKGRFTISRDNSKNTLYLQMNSLRPEDTAVYYCARDGVSARGTPFDYWGQGTLVTVSS

SEQ ID NO: 947 - DNA, 24 bp, Artificial Sequence
  Description of Artificial Sequence: Synthetic oligonucleotide
ggatttagtttcagggactatggc

SEQ ID NO: 948 - protein, 8 aa, Artificial Sequence
  Description of Artificial Sequence: Synthetic peptide
GFSFRDYG

SEQ ID NO: 949 - DNA, 24 bp, Artificial Sequence
  Description of Artificial Sequence: Synthetic oligonucleotide
atatggtataatggaaagaataaa

SEQ ID NO: 950 - protein, 8 aa, Artificial Sequence
  Description of Artificial Sequence: Synthetic peptide
IWYNGKNK

SEQ ID NO: 951 - DNA, 42 bp, Artificial Sequence
  Description of Artificial Sequence: Synthetic oligonucleotide
gcgagagatggtgtatcagcacgtggtactccatttgactac

SEQ ID NO: 952 - protein, 14 aa, Artificial Sequence
  Description of Artificial Sequence: Synthetic peptide
ARDGVSARGTPFDY

SEQ ID NO: 953 - DNA, 321 bp, Artificial Sequence
  Description of Artificial Sequence: Synthetic polynucleotide
gaaacgacactcacgcagtctccagcattcatgtcagcggctccaggagacaaagtcagcatctcctgcattgccagccagtacattgatgatgatgtgaactggtaccaacagaaaccaggagaaactgctattttcattattcaagaagcttctactctcgttcctggaatctcacctcgattcagtggcagcgggtatggaacacattttaccctcacaattaataacatagattctgaggatgctgcattttacttctgtctccaacatgataatttcccgtacacttttggccaggggaccaagctggagatcaaa

SEQ ID NO: 954 - protein, 107 aa, Artificial Sequence
  Description of Artificial Sequence: Synthetic polypeptide
ETTLTQSPAFMSAAPGDKVSISCIASQYIDDDVNWYQQKPGETAIFIIQEASTLVPGISPRFSGSGYGTHFTLTINNIDSEDAAFYFCLQHDNFPYTFGQGTKLEIK

SEQ ID NO: 955 - DNA, 18 bp, Artificial Sequence
  Description of Artificial Sequence: Synthetic oligonucleotide
cagtacattgatgatgat

SEQ ID NO: 956 - protein, 6 aa, Artificial Sequence
  Description of Artificial Sequence: Synthetic peptide
QYIDDD

SEQ ID NO: 957 - DNA, 9 bp, Artificial Sequence
  Description of Artificial Sequence: Synthetic oligonucleotide
gaagcttct

SEQ ID NO: 958 - protein, 3 aa, Artificial Sequence
  Description of Artificial Sequence: Synthetic peptide
EAS

SEQ ID NO: 959 - DNA, 27 bp, Artificial Sequence
  Description of Artificial Sequence: Synthetic oligonucleotide
ctccaacatgataatttcccgtacact

SEQ ID NO: 960 - protein, 9 aa, Artificial Sequence
  Description of Artificial Sequence: Synthetic peptide
LQHDNFPYT

SEQ ID NO: 961 - DNA, 384 bp, Artificial Sequence
  Description of Artificial Sequence: Synthetic polynucleotide
caggtgcagctggtggagtctgggggaggcttggtacagcctggggggtccctgagactctcctgtgcagcctcttatttcacctttagcagttttgccatgaactgggtccgccaggctccagggcagggcctggagtgggtctcagctattagtggtagggtctcagctattagtggtagtggtggtatcacatactacgcagactccgtgaagggccggttcatcatctccagagacaattccaagaacacgctgtatctgcaaatgagcggcctgagagccgaggacacggccgtatattactgtgcgaaaggcccctatttgactacagtcaccccctttgactactggggccagggaaccctggtcaccgtctcctca

SEQ ID NO: 962 - protein, 128 aa, Artificial Sequence
  Description of Artificial Sequence: Synthetic polypeptide
QVQLVESGGGLVQPGGSLRLSCAASYFTFSSFAMNWVRQAPGQGLEWVSAISGRVSAISGSGGITYYADSVKGRFIISRDNSKNTLYLQMSGLRAEDTAVYYCAKGPYLTTVTPFDYWGQGTLVTVSS

SEQ ID NO: 963 - DNA, 24 bp, Artificial Sequence
  Description of Artificial Sequence: Synthetic oligonucleotide
tatttcacctttagcagttttgcc

SEQ ID NO: 964 - protein, 8 aa, Artificial Sequence
  Description of Artificial Sequence: Synthetic peptide
YFTFSSFA

SEQ ID NO: 965 - DNA, 24 bp, Artificial Sequence
  Description of Artificial Sequence: Synthetic oligonucleotide
attagtggtagtggtggtatcaca

SEQ ID NO: 966 - protein, 8 aa, Artificial Sequence
  Description of Artificial Sequence: Synthetic peptide
ISGSGGIT

SEQ ID NO: 967 - DNA, 42 bp, Artificial Sequence
  Description of Artificial Sequence: Synthetic oligonucleotide
gcgaaaggcccctatttgactacagtcaccccctttgactac

SEQ ID NO: 968 - protein, 14 aa, Artificial Sequence
  Description of Artificial Sequence: Synthetic peptide
AKGPYLTTVTPFDY

SEQ ID NO: 969 - DNA, 324 bp, Artificial Sequence
  Description of Artificial Sequence: Synthetic polynucleotide
gacatccagttgacccagtctccatcttccgtgtctgcatctgtcggagacagagtcaccatcacttgtcgggcgagtcaggggattagcagctggttagcctggtatcagcagaaaccagggaaagcccctaaactcctgatctatgctgtatccagtttgcaaaatggggtcccatcaaggttcagcggcagtggatctgggacagatttcaccctcaccatcagcagcctgcagcctgaagactttgcaacttactattgtcaacaggctaacagtttcccattcactttcggccctgggaccaagctggagatcaaacga

SEQ ID NO: 970 - protein, 108 aa, Artificial Sequence
  Description of Artificial Sequence: Synthetic polypeptide
DIQLTQSPSSVSASVGDRVTITCRASQGISSWLAWYQQKPGKAPKLLIYAVSSLQNGVPSRFSGSGSGTDFTLTISSLQPEDFATYYCQQANSFPFTFGPGTKLEIKR

SEQ ID NO: 971 - DNA, 18 bp, Artificial Sequence
  Description of Artificial Sequence: Synthetic oligonucleotide
caggggattagcagctgg

SEQ ID NO: 972 - protein, 6 aa, Artificial Sequence
  Description of Artificial Sequence: Synthetic peptide
QGISSW

SEQ ID NO: 973 - DNA, 9 bp, Artificial Sequence
  Description of Artificial Sequence: Synthetic oligonucleotide
gctgtatcc

SEQ ID NO: 974 - protein, 3 aa, Artificial Sequence
  Description of Artificial Sequence: Synthetic peptide
AVS

SEQ ID NO: 975 - DNA, 27 bp, Artificial Sequence
  Description of Artificial Sequence: Synthetic oligonucleotide
caacaggctaacagtttcccattcact

SEQ ID NO: 976 - protein, 9 aa, Artificial Sequence
  Description of Artificial Sequence: Synthetic peptide
QQANSFPFT

SEQ ID NO: 977 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgctgattatgccatgcactgggtccggcaagctccagggaagggcctggagtgggtctcaggtattagttggaatagtggtagtataggttatgcggactctgtgaagggccgattcaccatctccagagacaacgccaagaactccctgtatctgcaaatgaacagtctgagagctgaggacacggccttatattactgtgtaaaagataatagtggctacgcatcctactactacggtatggacgtctggggccaagggaccacggtcaccgtctcctca

SEQ ID NO: 978 - protein, 123 aa, Artificial Sequence
  Description of Artificial Sequence: Synthetic polypeptide
EVQLVESGGGLVQPGRSLRLSCAASGFTFADYAMHWVRQAPGKGLEWVSGISWNSGSIGYADSVKGRFTISRDNAKNSLYLQMNSLRAEDTALYYCVKDNSGYASYYYGMDVWGQGTTVTVSS

SEQ ID NO: 979 - DNA, 24 bp, Artificial Sequence
  Description of Artificial Sequence: Synthetic oligonucleotide
ggattcacctttgctgattatgcc

SEQ ID NO: 980 - protein, 8 aa, Artificial Sequence
  Description of Artificial Sequence: Synthetic peptide
GFTFADYA

SEQ ID NO: 981 - DNA, 24 bp, Artificial Sequence
  Description of Artificial Sequence: Synthetic oligonucleotide
attagttggaatagtggtagtata

SEQ ID NO: 982 - protein, 8 aa, Artificial Sequence
  Description of Artificial Sequence: Synthetic peptide
ISWNSGSI

SEQ ID NO: 983 - DNA, 48 bp, Artificial Sequence
  Description of Artificial Sequence: Synthetic oligonucleotide
gtaaaagataatagtggctacgcatcctactactacggtatggacgtc

SEQ ID NO: 984 - protein, 16 aa, Artificial Sequence
  Description of Artificial Sequence: Synthetic peptide
VKDNSGYASYYYGMDV

SEQ ID NO: 985 - DNA, 324 bp, Artificial Sequence
  Description of Artificial Sequence: Synthetic polynucleotide
gacatccagttgacccagtccccatcctccctgtctgcatctgtaggagacagagtcaccatcacttgccgggcaagtcagagcattagcagctatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccattcactttcggccctgggaccaaagtggatatcaaacga

SEQ ID NO: 986 - protein, 108 aa, Artificial Sequence
  Description of Artificial Sequence: Synthetic polypeptide
DIQLTQSPSSLSASVGDRVTITCRASQSISSYLNWYQQKPGKAPKLLIYDASNLETGVPSRFSGSGSGTDFTFTISSLQPEDIATYYCQQYDNLPFTFGPGTKVDIKR

SEQ ID NO: 987 - DNA, 18 bp, Artificial Sequence
  Description of Artificial Sequence: Synthetic oligonucleotide
cagagcattagcagctat

SEQ ID NO: 988 - protein, 6 aa, Artificial Sequence
  Description of Artificial Sequence: Synthetic peptide
QSISSY

SEQ ID NO: 989 - DNA, 9 bp, Artificial Sequence
  Description of Artificial Sequence: Synthetic oligonucleotide
gatgcatcc

SEQ ID NO: 990 - protein, 3 aa, Artificial Sequence
  Description of Artificial Sequence: Synthetic peptide
DAS

SEQ ID NO: 991 - DNA, 27 bp, Artificial Sequence
  Description of Artificial Sequence: Synthetic oligonucleotide
caacagtatgataatctcccattcact

SEQ ID NO: 992 - protein, 9 aa, Artificial Sequence
  Description of Artificial Sequence: Synthetic peptide
QQYDNLPFT

SEQ ID NO: 993 - DNA, 378 bp, Artificial Sequence
  Description of Artificial Sequence: Synthetic polynucleotide
gaggtgcagctggtggagtctgggggaggcgtggtccagcctgggaggtccctgagactctcctgtgcagcctctggattcaccttcagtaactatggcatgcactgggtccgccaggctccaggcaaagggctggagtgggtgacagttatattacatgatggaagttataaatactatgcagactccgtgaagggccgattcaccatctccagagacaattccaagaacacgctacatctgcaaatgaacagcctgagaactgaggacacggctgtatattactgtgcgaaagggcctatgtttcggggagtcccttacaaccactactatggtatggacgtctggggccaagggaccacggtcaccgtctcctca

SEQ ID NO: 994 - protein, 126 aa, Artificial Sequence
  Description of Artificial Sequence: Synthetic polypeptide
EVQLVESGGGVVQPGRSLRLSCAASGFTFSNYGMHWVRQAPGKGLEWVTVILHDGSYKYYADSVKGRFTISRDNSKNTLHLQMNSLRTEDTAVYYCAKGPMFRGVPYNHYYGMDVWGQGTTVTVSS

SEQ ID NO: 995 - DNA, 24 bp, Artificial Sequence
  Description of Artificial Sequence: Synthetic oligonucleotide
ggattcaccttcagtaactatggc

SEQ ID NO: 996 - protein, 8 aa, Artificial Sequence
  Description of Artificial Sequence: Synthetic peptide
GFTFSNYG

SEQ ID NO: 997 - DNA, 24 bp, Artificial Sequence
  Description of Artificial Sequence: Synthetic oligonucleotide
atattacatgatggaagttataaa

SEQ ID NO: 998 - protein, 8 aa, Artificial Sequence
  Description of Artificial Sequence: Synthetic peptide
ILHDGSYK

SEQ ID NO: 999 - DNA, 57 bp, Artificial Sequence
  Description of Artificial Sequence: Synthetic oligonucleotide
gcgaaagggcctatgtttcggggagtcccttacaaccactactatggtatggacgtc

SEQ ID NO: 1000 - protein, 19 aa, Artificial Sequence
  Description of Artificial Sequence: Synthetic peptide
AKGPMFRGVPYNHYYGMDV

SEQ ID NO: 1001 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcatcagaaatgatttaggctggtatcagcagaaaccagggaaagcccctaagcgcctgatctatgctgcatccagtttgcaaagtggggtctcatcaaggttcagcggcagtggatctgggacagaattcactctcacaatcagcagcctgcagcctgaagattttgcaacttattactgtctacagcataatagttacccgtacacttttggccaggggaccaaggtggaaatcaaacga

SEQ ID NO: 1002 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVSSRFSGSGSGTEFTLTISSLQPEDFATYYCLQHNSYPYTFGQGTKVEIKR

SEQ ID NO: 1003 - DNA, 18 bp, Artificial Sequence
  Description of Artificial Sequence: Synthetic oligonucleotide
cagggcatcagaaatgat

SEQ ID NO: 1004 - protein, 6 aa, Artificial Sequence
  Description of Artificial Sequence: Synthetic peptide
QGIRND

SEQ ID NO: 1005 - DNA, 9 bp, Artificial Sequence
  Description of Artificial Sequence: Synthetic oligonucleotide
gctgcatcc

SEQ ID NO: 1006 - protein, 3 aa, Artificial Sequence
  Description of Artificial Sequence: Synthetic peptide
AAS

SEQ ID NO: 1007 - DNA, 27 bp, Artificial Sequence
  Description of Artificial Sequence: Synthetic oligonucleotide
ctacagcataatagttacccgtacact

SEQ ID NO: 1008 - protein, 9 aa, Artificial Sequence
  Description of Artificial Sequence: Synthetic peptide
LQHNSYPYT

SEQ ID NO: 1009 - DNA, 357 bp, Artificial Sequence
  Description of Artificial Sequence: Synthetic polynucleotide
gaggtgcagctggtggagtctgggggaggcgtggtccagcctgggaggtccctgagactctcctgtacagcgtcaggtttccccttcagtcgctatggcatgcactgggtccgccaggctccaggcaaggggctggaatgggtgacatttatatggtatgatggaagtaataaatactatgcagactccgcgaagggccgattcaccatcaccagagacaattccaagaacacggtgtatctgcaaatggacagcctgagagccgatgacacggctgtttattattgtgtgagagatcaggcagctctctactattttgactcttggggccagggaaccctggtcaccgtctcctca

SEQ ID NO: 1010 - protein, 119 aa, Artificial Sequence
  Description of Artificial Sequence: Synthetic polypeptide
EVQLVESGGGVVQPGRSLRLSCTASGFPFSRYGMHWVRQAPGKGLEWVTFIWYDGSNKYYADSAKGRFTITRDNSKNTVYLQMDSLRADDTAVYYCVRDQAALYYFDSWGQGTLVTVSS

SEQ ID NO: 1011 - DNA, 24 bp, Artificial Sequence
  Description of Artificial Sequence: Synthetic oligonucleotide
ggtttccccttcagtcgctatggc

SEQ ID NO: 1012 - protein, 8 aa, Artificial Sequence
  Description of Artificial Sequence: Synthetic peptide
GFPFSRYG

SEQ ID NO: 1013 - DNA, 24 bp, Artificial Sequence
  Description of Artificial Sequence: Synthetic oligonucleotide
atatggtatgatggaagtaataaa

SEQ ID NO: 1014 - protein, 8 aa, Artificial Sequence
  Description of Artificial Sequence: Synthetic peptide
IWYDGSNK

SEQ ID NO: 1015 - DNA, 36 bp, Artificial Sequence
  Description of Artificial Sequence: Synthetic oligonucleotide
gtgagagatcaggcagctctctactattttgactct

SEQ ID NO: 1016 - protein, 12 aa, Artificial Sequence
  Description of Artificial Sequence: Synthetic peptide
VRDQAALYYFDS

SEQ ID NO: 1017 - DNA, 324 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctctgctgcatccagtttgcaaagtggagtcccatcaaggttcagcggcagtggatctgggacagatttcactctcaccatcagcggcctgcagcctgaagattttgcaacttactattgtcaaaaggctaacagtttccctttcactttcggccctgggaccaagctggagatcaaacga

SEQ ID NO: 1018 - protein, 108 aa, Artificial Sequence
  Description of Artificial Sequence: Synthetic polypeptide
DIQMTQSPSSVSASVGDRVTITCRASQGISRWLAWYQQKPGKAPKLLISAASSLQSGVPSRFSGSGSGTDFTLTISGLQPEDFATYYCQKANSFPFTFGPGTKLEIKR

SEQ ID NO: 1019 - DNA, 18 bp, Artificial Sequence
  Description of Artificial Sequence: Synthetic oligonucleotide
cagggtattagcaggtgg

SEQ ID NO: 1020 - protein, 6 aa, Artificial Sequence
  Description of Artificial Sequence: Synthetic peptide
QGISRW

SEQ ID NO: 1021 - DNA, 9 bp, Artificial Sequence
  Description of Artificial Sequence: Synthetic oligonucleotide
gctgcatcc

SEQ ID NO: 1022 - protein, 3 aa, Artificial Sequence
  Description of Artificial Sequence: Synthetic peptide
AAS

SEQ ID NO: 1023 - DNA, 27 bp, Artificial Sequence
  Description of Artificial Sequence: Synthetic oligonucleotide
caaaaggctaacagtttccctttcact

SEQ ID NO: 1024 - protein, 9 aa, Artificial Sequence
  Description of Artificial Sequence: Synthetic peptide
QKANSFPFT

SEQ ID NO: 1025 - DNA, 378 bp, Artificial Sequence
  Description of Artificial Sequence: Synthetic polynucleotide
gaggtgcagctggtggagtctgggggaggcgtggtccagcctgggaggtccctgagactctcctgtgcagcctctggattcaccttcagtagttatggcatgcactgggtccgccaggctccaggcaaggggctggagtgggtgacagttatattacatgatggaagtaatagatactctgcagactccgtgaagggccgattcaccatctccagagacaattccaagaacacgctttatctgcaaatgaacatcctgagagttgaggacacggctgtgtattactgtacgaaaggggctatggttcggggagtcccttacaatcactactacggcatggacgtctggggccaagggaccacggtcaccgtctcctca

SEQ ID NO: 1026 - protein, 126 aa, Artificial Sequence
  Description of Artificial Sequence: Synthetic polypeptide
EVQLVESGGGVVQPGRSLRLSCAASGFTFSSYGMHWVRQAPGKGLEWVTVILHDGSNRYSADSVKGRFTISRDNSKNTLYLQMNILRVEDTAVYYCTKGAMVRGVPYNHYYGMDVWGQGTTVTVSS

SEQ ID NO: 1027 - DNA, 24 bp, Artificial Sequence
  Description of Artificial Sequence: Synthetic oligonucleotide
ggattcaccttcagtagttatggc

SEQ ID NO: 1028 - protein, 8 aa, Artificial Sequence
  Description of Artificial Sequence: Synthetic peptide
GFTFSSYG

SEQ ID NO: 1029 - DNA, 24 bp, Artificial Sequence
  Description of Artificial Sequence: Synthetic oligonucleotide
atattacatgatggaagtaataga

SEQ ID NO: 1030 - protein, 8 aa, Artificial Sequence
  Description of Artificial Sequence: Synthetic peptide
ILHDGSNR

SEQ ID NO: 1031 - DNA, 57 bp, Artificial Sequence
  Description of Artificial Sequence: Synthetic oligonucleotide
acgaaaggggctatggttcggggagtcccttacaatcactactacggcatggacgtc

SEQ ID NO: 1032 - protein, 19 aa, Artificial Sequence
  Description of Artificial Sequence: Synthetic peptide
TKGAMVRGVPYNHYYGMDV

SEQ ID NO: 1033 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctaatctatgctgcatccattttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 1034 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASILQSGVPSRFSGSGSGTEFTLTISSLQPEDFATYYCLQHNSYPYTFGQGTKLEIKR

SEQ ID NO: 1035 - DNA, 18 bp, Artificial Sequence
  Description of Artificial Sequence: Synthetic oligonucleotide
cagggcattagaaatgat

SEQ ID NO: 1036 - protein, 6 aa, Artificial Sequence
  Description of Artificial Sequence: Synthetic peptide
QGIRND

SEQ ID NO: 1037 - DNA, 9 bp, Artificial Sequence
  Description of Artificial Sequence: Synthetic oligonucleotide
gctgcatcc

SEQ ID NO: 1038 - protein, 3 aa, Artificial Sequence
  Description of Artificial Sequence: Synthetic peptide
AAS

SEQ ID NO: 1039 - DNA, 27 bp, Artificial Sequence
  Description of Artificial Sequence: Synthetic oligonucleotide
ctacagcataatagttacccgtacact

SEQ ID NO: 1040 - protein, 9 aa, Artificial Sequence
  Description of Artificial Sequence: Synthetic peptide
LQHNSYPYT

SEQ ID NO: 1041 - DNA, 378 bp, Artificial Sequence
  Description of Artificial Sequence: Synthetic polynucleotide
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatattacatgatggaagtaatagatactatgcagactccgtgaagggccgattcaccatctccagagacaattccaagaacacgctttatctgcaaatgaacatcctgagagctgaggacacggctgtgtattactgtacgaaaggggctatggttcggggagtcccttacaatcactactacggcatggacgtctggggccaagggaccacggtcaccgtctcctca

SEQ ID NO: 1042 - protein, 126 aa, Artificial Sequence
  Description of Artificial Sequence: Synthetic polypeptide
EVQLVESGGGVVQPGRSLRLSCAASGFTFSSYGMHWVRQAPGKGLEWVTVILHDGSNRYYADSVKGRFTISRDNSKNTLYLQMNILRAEDTAVYYCTKGAMVRGVPYNHYYGMDVWGQGTTVTVSS

SEQ ID NO: 1043 - DNA, 24 bp, Artificial Sequence
  Description of Artificial Sequence: Synthetic oligonucleotide
ggattcaccttcagtagctatggc

SEQ ID NO: 1044 - protein, 8 aa, Artificial Sequence
  Description of Artificial Sequence: Synthetic peptide
GFTFSSYG

SEQ ID NO: 1045 - DNA, 24 bp, Artificial Sequence
  Description of Artificial Sequence: Synthetic oligonucleotide
atattacatgatggaagtaataga

SEQ ID NO: 1046 - protein, 8 aa, Artificial Sequence
  Description of Artificial Sequence: Synthetic peptide
ILHDGSNR

SEQ ID NO: 1047 - DNA, 57 bp, Artificial Sequence; identical to SEQ ID NO: 1031
  Description of Artificial Sequence: Synthetic oligonucleotide

SEQ ID NO: 1048 - protein, 19 aa, Artificial Sequence
  Description of Artificial Sequence: Synthetic peptide
TKGAMVRGVPYNHYYGMDV

SEQ ID NO: 1049 - DNA, 324 bp, Artificial Sequence
  Description of Artificial Sequence: Synthetic polynucleotide
gacatcgtgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 1050 - protein, 108 aa, Artificial Sequence
  Description of Artificial Sequence: Synthetic polypeptide
DIVMTQSPSSLSASVGDRVTITCRASQGIRNDLGWYQQKPGKAPKRLIYAASNLQSGVPSRFSGSGSGTEFTLTISSLQPEDFATYYCLQHNSYPYTFGQGTKLEIKR

SEQ ID NO: 1051 - DNA, 18 bp, Artificial Sequence
  Description of Artificial Sequence: Synthetic oligonucleotide
cagggcattagaaatgat

SEQ ID NO: 1052 - protein, 6 aa, Artificial Sequence
  Description of Artificial Sequence: Synthetic peptide
QGIRND

SEQ ID NO: 1053 - DNA, 9 bp, Artificial Sequence
  Description of Artificial Sequence: Synthetic oligonucleotide
gctgcatcc

SEQ ID NO: 1054 - protein, 3 aa, Artificial Sequence
  Description of Artificial Sequence: Synthetic peptide
AAS

SEQ ID NO: 1055 - DNA, 27 bp, Artificial Sequence
  Description of Artificial Sequence: Synthetic oligonucleotide
ctacagcataatagttacccgtacact

SEQ ID NO: 1056 - protein, 9 aa, Artificial Sequence
  Description of Artificial Sequence: Synthetic peptide
LQHNSYPYT

SEQ ID NO: 1057 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagactattccaagaacacgctgtatctgcaaatgaacagcctgagagctgaggacacggctgtgttttactgtgcgaaaggggctatggttcggggagtcccttacaactactactacggtatggacgtctggggccaagggaccacggtcaccgtctcctca

SEQ ID NO: 1058 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDYSKNTLYLQMNSLRAEDTAVFYCAKGAMVRGVPYNYYYGMDVWGQGTTVTVSS

SEQ ID NO: 1059 - DNA, 24 bp, Artificial Sequence
  Description of Artificial Sequence: Synthetic oligonucleotide
ggattcaccttcagtagctatggc

SEQ ID NO: 1060 - protein, 8 aa, Artificial Sequence
  Description of Artificial Sequence: Synthetic peptide
GFTFSSYG

SEQ ID NO: 1061 - DNA, 24 bp, Artificial Sequence
  Description of Artificial Sequence: Synthetic oligonucleotide
atatcatatgatggaagtaataaa

SEQ ID NO: 1062 - protein, 8 aa, Artificial Sequence
  Description of Artificial Sequence: Synthetic peptide
ISYDGSNK

SEQ ID NO: 1063 - DNA, 57 bp, Artificial Sequence
  Description of Artificial Sequence: Synthetic oligonucleotide
gcgaaaggggctatggttcggggagtcccttacaactactactacggtatggacgtc

SEQ ID NO: 1064 - protein, 19 aa, Artificial Sequence
  Description of Artificial Sequence: Synthetic peptide
AKGAMVRGVPYNYYYGMDV

SEQ ID NO: 1065 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1066 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASSLQSGVPSRFSGSGSGTEFTLTISSLQPEDFATYYCLQHNSYPYTFGQGTKLEIK

SEQ ID NO: 1067 - DNA, 18 bp, Artificial Sequence
  Description of Artificial Sequence: Synthetic oligonucleotide
cagggcattagaaatgat

SEQ ID NO: 1068 - protein, 6 aa, Artificial Sequence
  Description of Artificial Sequence: Synthetic peptide
QGIRND

SEQ ID NO: 1069 - DNA, 9 bp, Artificial Sequence
  Description of Artificial Sequence: Synthetic oligonucleotide
gctgcatcc

SEQ ID NO: 1070 - protein, 3 aa, Artificial Sequence
  Description of Artificial Sequence: Synthetic peptide
AAS

SEQ ID NO: 1071 - DNA, 27 bp, Artificial Sequence
  Description of Artificial Sequence: Synthetic oligonucleotide
ctacagcataatagttacccgtacact

SEQ ID NO: 1072 - protein, 9 aa, Artificial Sequence
  Description of Artificial Sequence: Synthetic peptide
LQHNSYPYT

SEQ ID NO: 1073 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcctctggactcaccttcagtagctatggcatgcactgggtccgccaggctccaggcaaggggctggagtgggtggcagttatatcatatgatggaagtaataaatactatacagactccgtgaagggccgattcaccatctccagagacaattctaagaacacgctgtatctgcaaatgaacagcctgagagctgaggacacggctgtgtattactgtgcgaaaggggccatggttcggggagtcccttacaactactactacggtatggacgtctggggccaagggaccacggtcaccgtctcctca

SEQ ID NO: 1074 - protein, 126 aa, Artificial Sequence
  Description of Artificial Sequence: Synthetic polypeptide
QVQLVESGGGVVQPGRSLRLSCAASGLTFSSYGMHWVRQAPGKGLEWVAVISYDGSNKYYTDSVKGRFTISRDNSKNTLYLQMNSLRAEDTAVYYCAKGAMVRGVPYNYYYGMDVWGQGTTVTVSS

SEQ ID NO: 1075 - DNA, 24 bp, Artificial Sequence
  Description of Artificial Sequence: Synthetic oligonucleotide
ggactcaccttcagtagctatggc

SEQ ID NO: 1076 - protein, 8 aa, Artificial Sequence
  Description of Artificial Sequence: Synthetic peptide
GLTFSSYG

SEQ ID NO: 1077 - DNA, 24 bp, Artificial Sequence
  Description of Artificial Sequence: Synthetic oligonucleotide
atatcatatgatggaagtaataaa

SEQ ID NO: 1078 - protein, 8 aa, Artificial Sequence
  Description of Artificial Sequence: Synthetic peptide
ISYDGSNK

SEQ ID NO: 1079 - DNA, 57 bp, Artificial Sequence
  Description of Artificial Sequence: Synthetic oligonucleotide
gcgaaaggggccatggttcggggagtcccttacaactactactacggtatggacgtc

SEQ ID NO: 1080 - protein, 19 aa, Artificial Sequence
  Description of Artificial Sequence: Synthetic peptide
AKGAMVRGVPYNYYYGMDV

SEQ ID NO: 1081 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcgtccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1082 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 1083 - DNA, 18 bp, Artificial Sequence
  Description of Artificial Sequence: Synthetic oligonucleotide
cagggcattagaaatgat

SEQ ID NO: 1084 - protein, 6 aa, Artificial Sequence
  Description of Artificial Sequence: Synthetic peptide
QGIRND

SEQ ID NO: 1085 - DNA, 9 bp, Artificial Sequence
  Description of Artificial Sequence: Synthetic oligonucleotide
gctgcgtcc

SEQ ID NO: 1086 - protein, 3 aa, Artificial Sequence
  Description of Artificial Sequence: Synthetic peptide
AAS

SEQ ID NO: 1087 - DNA, 27 bp, Artificial Sequence
  Description of Artificial Sequence: Synthetic oligonucleotide
ctacagcataatagttacccgtacact

SEQ ID NO: 1088 - protein, 9 aa, Artificial Sequence
  Description of Artificial Sequence: Synthetic peptide
LQHNSYPYT

SEQ ID NO: 1089 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcaggagctttggcatgcactgggtccgccaggctccaggcaaggggctggagtgggtggcagttatttcatatgatggaaattataaatactatgcagactccgtgaagggccgattcaccatctccagagacaattccaagaacacgctgtatctgcaaatgaacagcctgagagctgaggacacggctgtacattactgtgcgaaaggggctatggttcggggagtcccttacaacttctactacggtatggacgtctggggccaagggaccacggtcaccgtctcctca

SEQ ID NO: 1090 - protein, 126 aa, Artificial Sequence
  Description of Artificial Sequence: Synthetic polypeptide
QVQLVESGGGVVQPGRSLRLSCAASGFTFRSFGMHWVRQAPGKGLEWVAVISYDGNYKYYADSVKGRFTISRDNSKNTLYLQMNSLRAEDTAVHYCAKGAMVRGVPYNFYYGMDVWGQGTTVTVSS

SEQ ID NO: 1091 - DNA, 24 bp, Artificial Sequence
  Description of Artificial Sequence: Synthetic oligonucleotide
ggattcaccttcaggagctttggc

SEQ ID NO: 1092 - protein, 8 aa, Artificial Sequence
  Description of Artificial Sequence: Synthetic peptide
GFTFRSFG

SEQ ID NO: 1093 - DNA, 24 bp, Artificial Sequence
  Description of Artificial Sequence: Synthetic oligonucleotide
atttcatatgatggaaattataaa

SEQ ID NO: 1094 - protein, 8 aa, Artificial Sequence
  Description of Artificial Sequence: Synthetic peptide
ISYDGNYK

SEQ ID NO: 1095 - DNA, 57 bp, Artificial Sequence
  Description of Artificial Sequence: Synthetic oligonucleotide
gcgaaaggggctatggttcggggagtcccttacaacttctactacggtatggacgtc

SEQ ID NO: 1096 - protein, 19 aa, Artificial Sequence
  Description of Artificial Sequence: Synthetic peptide
AKGAMVRGVPYNFYYGMDV

SEQ ID NO: 1097 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggtcattagaaatgatttaggctggtatcagcagaaaccagggaaagcccctaagcgcctgatctatgctgcatccagtttgcaaagtgggatcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1098 - protein, 107 aa, Artificial Sequence
  Description of Artificial Sequence: Synthetic polypeptide
DIQMTQSPSSLSASVGDRVTITCRASQVIRNDLGWYQQKPGKAPKRLIYAASSLQSGIPSRFSGSGSGTEFTLTISSLQPEDFATYYCLQHNSYPYTFGQGTKLEIK

SEQ ID NO: 1099 - DNA, 18 bp, Artificial Sequence
  Description of Artificial Sequence: Synthetic oligonucleotide
caggtcattagaaatgat

SEQ ID NO: 1100 - protein, 6 aa, Artificial Sequence
  Description of Artificial Sequence: Synthetic peptide
QVIRND

SEQ ID NO: 1101 - DNA, 9 bp, Artificial Sequence
  Description of Artificial Sequence: Synthetic oligonucleotide
gctgcatcc

SEQ ID NO: 1102 - protein, 3 aa, Artificial Sequence
  Description of Artificial Sequence: Synthetic peptide
AAS

SEQ ID NO: 1103 - DNA, 27 bp, Artificial Sequence
  Description of Artificial Sequence: Synthetic oligonucleotide
ctacagcataatagttacccgtacact

SEQ ID NO: 1104 - protein, 9 aa, Artificial Sequence
  Description of Artificial Sequence: Synthetic peptide
LQHNSYPYT

SEQ ID NO: 1105 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattataccatgcactgggtccggcaagttccaggaaagggcctggagtggatctcaggtattagttggaatagtggtagcatggactatgcggactctgtgaagggccgattcaccatctctagagacaacgccaggaactccctgtttctgcaaatgaacagtgtgagaactgaggacacggccttgtattactgtgcaaaagataagagtggctacggctccttctactacggtatggacgtctggggccaggggaccacggtcaccgtctcctca

SEQ ID NO: 1106 - protein, 123 aa, Artificial Sequence
  Description of Artificial Sequence: Synthetic polypeptide
EVQLVESGGGLVQPGRSLRLSCAASGFTFDDYTMHWVRQVPGKGLEWISGISWNSGSMDYADSVKGRFTISRDNARNSLFLQMNSVRTEDTALYYCAKDKSGYGSFYYGMDVWGQGTTVTVSS

SEQ ID NO: 1107 - DNA, 24 bp, Artificial Sequence
  Description of Artificial Sequence: Synthetic oligonucleotide
ggattcacctttgatgattatacc

SEQ ID NO: 1108 - protein, 8 aa, Artificial Sequence
  Description of Artificial Sequence: Synthetic peptide
GFTFDDYT

SEQ ID NO: 1109 - DNA, 24 bp, Artificial Sequence
  Description of Artificial Sequence: Synthetic oligonucleotide
attagttggaatagtggtagcatg

SEQ ID NO: 1110 - protein, 8 aa, Artificial Sequence
  Description of Artificial Sequence: Synthetic peptide
ISWNSGSM

SEQ ID NO: 1111 - DNA, 48 bp, Artificial Sequence
  Description of Artificial Sequence: Synthetic oligonucleotide
gcaaaagataagagtggctacggctccttctactacggtatggacgtc

SEQ ID NO: 1112 - protein, 16 aa, Artificial Sequence
  Description of Artificial Sequence: Synthetic peptide
AKDKSGYGSFYYGMDV

SEQ ID NO: 1113 - DNA, 324 bp, Artificial Sequence
  Description of Artificial Sequence: Synthetic polynucleotide
gaaattgtgttgacgcagtctccaggcaccctgtctttgtctccaggggacagagccaccctctcctgcagggccagtcagagtgtcagcagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgctcactcaccgtacacttttggccaggggaccaagctggagatcaaa

SEQ ID NO: 1114 - protein, 108 aa, Artificial Sequence
  Description of Artificial Sequence: Synthetic polypeptide
EIVLTQSPGTLSLSPGDRATLSCRASQSVSSIYLAWYQQKPGQAPRLLIHGASTRATGIPDRFSGSGSGTDFTLTISRLEPEDFAVYYCQQRAHSPYTFGQGTKLEIK

SEQ ID NO: 1115 - DNA, 21 bp, Artificial Sequence
  Description of Artificial Sequence: Synthetic oligonucleotide
cagagtgtcagcagcatctac

SEQ ID NO: 1116 - protein, 7 aa, Artificial Sequence
  Description of Artificial Sequence: Synthetic peptide
QSVSSIY

SEQ ID NO: 1117 - DNA, 9 bp, Artificial Sequence
  Description of Artificial Sequence: Synthetic oligonucleotide
ggtgcgtcc

SEQ ID NO: 1118 - protein, 3 aa, Artificial Sequence
  Description of Artificial Sequence: Synthetic peptide
GAS

SEQ ID NO: 1119 - DNA, 27 bp, Artificial Sequence
  Description of Artificial Sequence: Synthetic oligonucleotide
cagcagcgtgctcactcaccgtacact

SEQ ID NO: 1120 - protein, 9 aa, Artificial Sequence
  Description of Artificial Sequence: Synthetic peptide
QQRAHSPYT

SEQ ID NO: 1121 - DNA, 369 bp, Artificial Sequence
  Description of Artificial Sequence: Synthetic polynucleotide
gaagtgcagctggtggagtctgggggaggcttggtacagcctggcaggtccctgagactctcctgtgcagcctctggcttcagctttgataattatgccatgcactgggtccggcaagctccaggacagggcctggagtgggtctcaggtattagttggaatagtggtagcagagactatgcggactctgtgaagggccgattcaccatctccagagacaatgccaggaactccctgtttctgcaaatgaacagtctgagtaatgaggacacggccatgtattactgcgcaaaagataagagtggctacggctcctacttctacggtatggacgtctggggccaagggaccacggtcaccgtctcctca

SEQ ID NO: 1122 - protein, 123 aa, Artificial Sequence
  Description of Artificial Sequence: Synthetic polypeptide
EVQLVESGGGLVQPGRSLRLSCAASGFSFDNYAMHWVRQAPGQGLEWVSGISWNSGSRDYADSVKGRFTISRDNARNSLFLQMNSLSNEDTAMYYCAKDKSGYGSYFYGMDVWGQGTTVTVSS

SEQ ID NO: 1123 - DNA, 24 bp, Artificial Sequence
  Description of Artificial Sequence: Synthetic oligonucleotide
ggcttcagctttgataattatgcc

SEQ ID NO: 1124 - protein, 8 aa, Artificial Sequence
  Description of Artificial Sequence: Synthetic peptide
GFSFDNYA

SEQ ID NO: 1125 - DNA, 24 bp, Artificial Sequence
  Description of Artificial Sequence: Synthetic oligonucleotide
attagttggaatagtggtagcaga

SEQ ID NO: 1126 - protein, 8 aa, Artificial Sequence
  Description of Artificial Sequence: Synthetic peptide
ISWNSGSR

SEQ ID NO: 1127 - DNA, 48 bp, Artificial Sequence
  Description of Artificial Sequence: Synthetic oligonucleotide
gcaaaagataagagtggctacggctcctacttctacggtatggacgtc

SEQ ID NO: 1128 - protein, 16 aa, Artificial Sequence
  Description of Artificial Sequence: Synthetic peptide
AKDKSGYGSYFYGMDV

SEQ ID NO: 1129 - DNA, 324 bp, Artificial Sequence
  Description of Artificial Sequence: Synthetic polynucleotide
gaaattgtgttgacgcagtctccaggcaccctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagtttaccgtacacttttggccaggggaccaagctggagatcaaa

SEQ ID NO: 1130 - protein, 108 aa, Artificial Sequence
  Description of Artificial Sequence: Synthetic polypeptide
EIVLTQSPGTLSLSPGDRATLSCRASQSIRNIYLAWYQQKPGQAPRLLIHGASTRATGIPDRFSGSGSGTDFTLTISRLEPEDFAVYYCQQRVSLPYTFGQGTKLEIK

SEQ ID NO: 1131 - DNA, 21 bp, Artificial Sequence
  Description of Artificial Sequence: Synthetic oligonucleotide
cagagtattagaaacatctat

SEQ ID NO: 1132 - protein, 7 aa, Artificial Sequence
  Description of Artificial Sequence: Synthetic peptide
QSIRNIY

SEQ ID NO: 1133 - DNA, 9 bp, Artificial Sequence
  Description of Artificial Sequence: Synthetic oligonucleotide
ggtgcgtcc

SEQ ID NO: 1134 - protein, 3 aa, Artificial Sequence
  Description of Artificial Sequence: Synthetic peptide
GAS

SEQ ID NO: 1135 - DNA, 27 bp, Artificial Sequence
  Description of Artificial Sequence: Synthetic oligonucleotide
cagcagcgtgttagtttaccgtacact

SEQ ID NO: 1136 - protein, 9 aa, Artificial Sequence
  Description of Artificial Sequence: Synthetic peptide
QQRVSLPYT

SEQ ID NO: 1137 - DNA, 369 bp, Artificial Sequence
  Description of Artificial Sequence: Synthetic polynucleotide
caggtgcagctggtggagtctgggggaggcttggtacagcctggcaggtccctgagactctcctgtgcagcctctggcttcagctttgatgattatgccatgcactgggtccggcaagctccaggacagggcctggagtgggtctcaggtattagttggaatggtggtagcagagactatgcggactctgtgaagggccgattcaccatctccagagacaacgccaggaactccctgtttctgcaaatgaacagtctgtttactgaggacacggccttgtattactgtgcaaaagataagagtggctacggctcctacttctacggtatggacgtctggggccaagggaccacggtcaccgtctcctca

SEQ ID NO: 1138 - protein, 123 aa, Artificial Sequence
  Description of Artificial Sequence: Synthetic polypeptide
QVQLVESGGGLVQPGRSLRLSCAASGFSFDDYAMHWVRQAPGQGLEWVSGISWNGGSRDYADSVKGRFTISRDNARNSLFLQMNSLFTEDTALYYCAKDKSGYGSYFYGMDVWGQGTTVTVSS

SEQ ID NO: 1139 - DNA, 24 bp, Artificial Sequence
  Description of Artificial Sequence: Synthetic oligonucleotide
ggcttcagctttgatgattatgcc

SEQ ID NO: 1140 - protein, 8 aa, Artificial Sequence
  Description of Artificial Sequence: Synthetic peptide
GFSFDDYA

SEQ ID NO: 1141 - DNA, 24 bp, Artificial Sequence
  Description of Artificial Sequence: Synthetic oligonucleotide
attagttggaatggtggtagcaga

SEQ ID NO: 1142 - protein, 8 aa, Artificial Sequence
  Description of Artificial Sequence: Synthetic peptide
ISWNGGSR

SEQ ID NO: 1143 - DNA, 48 bp, Artificial Sequence; identical to SEQ ID NO: 1127
  Description of Artificial Sequence: Synthetic oligonucleotide

SEQ ID NO: 1144 - protein, 16 aa, Artificial Sequence
  Description of Artificial Sequence: Synthetic peptide
AKDKSGYGSYFYGMDV

SEQ ID NO: 1145 - DNA, 324 bp, Artificial Sequence
  Description of Artificial Sequence: Synthetic polynucleotide
gaaattgtgttgacgcagtctccaggcattctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagttcaccgtacacttttggccaggggaccaagctggagatcaaa

SEQ ID NO: 1146 - protein, 108 aa, Artificial Sequence
  Description of Artificial Sequence: Synthetic polypeptide
EIVLTQSPGILSLSPGDRATLSCRASQSIRNIYLAWYQQKPGQAPRLLIHGASTRATGIPDRFSGSGSGTDFTLTISRLEPEDFAVYYCQQRVSSPYTFGQGTKLEIK

SEQ ID NO: 1147 - DNA, 21 bp, Artificial Sequence
  Description of Artificial Sequence: Synthetic oligonucleotide
cagagtattagaaacatctat

SEQ ID NO: 1148 - protein, 7 aa, Artificial Sequence
  Description of Artificial Sequence: Synthetic peptide
QSIRNIY

SEQ ID NO: 1149 - DNA, 9 bp, Artificial Sequence
  Description of Artificial Sequence: Synthetic oligonucleotide
ggtgcgtcc

SEQ ID NO: 1150 - protein, 3 aa, Artificial Sequence
  Description of Artificial Sequence: Synthetic peptide
GAS

SEQ ID NO: 1151 - DNA, 27 bp, Artificial Sequence
  Description of Artificial Sequence: Synthetic oligonucleotide
cagcagcgtgttagttcaccgtacact

SEQ ID NO: 1152 - protein, 9 aa, Artificial Sequence
  Description of Artificial Sequence: Synthetic peptide
QQRVSSPYT

SEQ ID NO: 1153 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagcagagactatgcggactctgtgaagggccgattcaccatctccagagacaacgccaggaactccctgtttctgcaaatgaacagtctgagtactgaggacacggccttgtattactgtgcaaaagataagagtggctacggctcctactactacggtatggacgtctggggccaagggaccacggtcaccgtctcctca

SEQ ID NO: 1154 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRDYADSVKGRFTISRDNARNSLFLQMNSLSTEDTALYYCAKDKSGYGSYYYGMDVWGQGTTVTVSS

SEQ ID NO: 1155 - DNA, 24 bp, Artificial Sequence
  Description of Artificial Sequence: Synthetic oligonucleotide
ggattcacctttgatgattatgcc

SEQ ID NO: 1156 - protein, 8 aa, Artificial Sequence
  Description of Artificial Sequence: Synthetic peptide
GFTFDDYA

SEQ ID NO: 1157 - DNA, 24 bp, Artificial Sequence
  Description of Artificial Sequence: Synthetic oligonucleotide
attagttggaatagtggtagcaga

SEQ ID NO: 1158 - protein, 8 aa, Artificial Sequence
  Description of Artificial Sequence: Synthetic peptide
ISWNSGSR

SEQ ID NO: 1159 - DNA, 48 bp, Artificial Sequence
  Description of Artificial Sequence: Synthetic oligonucleotide
gcaaaagataagagtggctacggctcctactactacggtatggacgtc

SEQ ID NO: 1160 - protein, 16 aa, Artificial Sequence
  Description of Artificial Sequence: Synthetic peptide
AKDKSGYGSYYYGMDV

SEQ ID NO: 1161 - DNA, 324 bp, Artificial Sequence
  Description of Artificial Sequence: Synthetic polynucleotide
gaaattgtgttgacgcagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 1162 - protein, 108 aa, Artificial Sequence
  Description of Artificial Sequence: Synthetic polypeptide
EIVLTQSPGTLSLSPGDRATLSCRASQSIRSIYLAWYQQKPGQAPRLLIHGASTRATGIPDRFSGSGSGTDFTLTISRLEPEDFAVYYCQQRVSSPYTFGQGTKLEIK

SEQ ID NO: 1163 - DNA, 21 bp, Artificial Sequence
  Description of Artificial Sequence: Synthetic oligonucleotide
cagagtattagaagcatctac

SEQ ID NO: 1164 - protein, 7 aa, Artificial Sequence
  Description of Artificial Sequence: Synthetic peptide
QSIRSIY

SEQ ID NO: 1165 - DNA, 9 bp, Artificial Sequence
  Description of Artificial Sequence: Synthetic oligonucleotide
ggtgcgtcc

SEQ ID NO: 1166 - protein, 3 aa, Artificial Sequence
  Description of Artificial Sequence: Synthetic peptide
GAS

SEQ ID NO: 1167 - DNA, 27 bp, Artificial Sequence
  Description of Artificial Sequence: Synthetic oligonucleotide
cagcagcgtgttagctcaccgtacact

SEQ ID NO: 1168 - protein, 9 aa, Artificial Sequence
  Description of Artificial Sequence: Synthetic peptide
QQRVSSPYT

SEQ ID NO: 1169 - DNA, 369 bp, Artificial Sequence
  Description of Artificial Sequence: Synthetic polynucleotide
gaagtgcagctggtggagtctgggggaggcttggtacagcctggcaggtccctgagactctcctgtgtagcctctggattcacctttgctgattttaccatgcactgggtccggcaagcgccagggaagggccttgagtgggtctcaggtattagttggaatagtaatagtatagactatgcggactctgtgaagggccgattcaccatctccagagacaacgccaagaaatccctgtttctgcaaatgtccagtctgagagctgaggacacggccttatattactgtgtcaaagacagaagcggatatagcagattctactacggtatggacgtctggggccaagggaccacggtcaccgtctcctca

SEQ ID NO: 1170 - protein, 123 aa, Artificial Sequence
  Description of Artificial Sequence: Synthetic polypeptide
EVQLVESGGGLVQPGRSLRLSCVASGFTFADFTMHWVRQAPGKGLEWVSGISWNSNSIDYADSVKGRFTISRDNAKKSLFLQMSSLRAEDTALYYCVKDRSGYSRFYYGMDVWGQGTTVTVSS

SEQ ID NO: 1171 - DNA, 24 bp, Artificial Sequence
  Description of Artificial Sequence: Synthetic oligonucleotide
ggattcacctttgctgattttacc

SEQ ID NO: 1172 - protein, 8 aa, Artificial Sequence
  Description of Artificial Sequence: Synthetic peptide
GFTFADFT

SEQ ID NO: 1173 - DNA, 24 bp, Artificial Sequence
  Description of Artificial Sequence: Synthetic oligonucleotide
attagttggaatagtaatagtata

SEQ ID NO: 1174 - protein, 8 aa, Artificial Sequence
  Description of Artificial Sequence: Synthetic peptide
ISWNSNSI

SEQ ID NO: 1175 - DNA, 48 bp, Artificial Sequence
  Description of Artificial Sequence: Synthetic oligonucleotide
gtcaaagacagaagcggatatagcagattctactacggtatggacgtc

SEQ ID NO: 1176 - protein, 16 aa, Artificial Sequence
  Description of Artificial Sequence: Synthetic peptide
VKDRSGYSRFYYGMDV

SEQ ID NO: 1177 - DNA, 321 bp, Artificial Sequence
  Description of Artificial Sequence: Synthetic polynucleotide
gaaattgtgatgacgcagtctccagccaccctgtctgtgtctccaggggaaagagccatcctctcctgcagggccagtcagaatattaatagcaacttggcctggtaccagcagaaacctggccaggctcccaggctcctcatctatggtgcatccaccagggccactggtgtcccagccaggttcagtggcagtgggtctgggacagagttcactctcaccatccgcagcctgcaatctgaagattttgcagtttattactgtcaacaatattataattggccgatcactttcggccacgggacacgactggagattaaa

SEQ ID NO: 1178 - protein, 107 aa, Artificial Sequence
  Description of Artificial Sequence: Synthetic polypeptide
EIVMTQSPATLSVSPGERAILSCRASQNINSNLAWYQQKPGQAPRLLIYGASTRATGVPARFSGSGSGTEFTLTIRSLQSEDFAVYYCQQYYNWPITFGHGTRLEIK

SEQ ID NO: 1179 - DNA, 18 bp, Artificial Sequence
  Description of Artificial Sequence: Synthetic oligonucleotide
cagaatattaatagcaac

SEQ ID NO: 1180 - protein, 6 aa, Artificial Sequence
  Description of Artificial Sequence: Synthetic peptide
QNINSN

SEQ ID NO: 1181 - DNA, 9 bp, Artificial Sequence
  Description of Artificial Sequence: Synthetic oligonucleotide
ggtgcatcc

SEQ ID NO: 1182 - protein, 3 aa, Artificial Sequence
  Description of Artificial Sequence: Synthetic peptide
GAS

SEQ ID NO: 1183 - DNA, 27 bp, Artificial Sequence
  Description of Artificial Sequence: Synthetic oligonucleotide
caacaatattataattggccgatcact

SEQ ID NO: 1184 - protein, 9 aa, Artificial Sequence
  Description of Artificial Sequence: Synthetic peptide
QQYYNWPIT

SEQ ID NO: 1185 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatggtggtagtaaagactatgcggactctgtgaagggccgattcaccatctccagagacaacaccaggaactccctgtctctgcaaatgaacagtctgagaattgaagacacggccttatattactgtgcaaaagataagagtggctacggctccttctactacggtttggacgtctggggccaagggaccacggtcaccgtctcctca

SEQ ID NO: 1186 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNGGSKDYADSVKGRFTISRDNTRNSLSLQMNSLRIEDTALYYCAKDKSGYGSFYYGLDVWGQGTTVTVSS

SEQ ID NO: 1187 - DNA, 24 bp, Artificial Sequence
  Description of Artificial Sequence: Synthetic oligonucleotide
ggattcacctttgatgattatgcc

SEQ ID NO: 1188 - protein, 8 aa, Artificial Sequence
  Description of Artificial Sequence: Synthetic peptide
GFTFDDYA

SEQ ID NO: 1189 - DNA, 24 bp, Artificial Sequence
  Description of Artificial Sequence: Synthetic oligonucleotide
attagttggaatggtggtagtaaa

SEQ ID NO: 1190 - protein, 8 aa, Artificial Sequence
  Description of Artificial Sequence: Synthetic peptide
ISWNGGSK

SEQ ID NO: 1191 - DNA, 48 bp, Artificial Sequence
  Description of Artificial Sequence: Synthetic oligonucleotide
gcaaaagataagagtggctacggctccttctactacggtttggacgtc

SEQ ID NO: 1192 - protein, 16 aa, Artificial Sequence
  Description of Artificial Sequence: Synthetic peptide
AKDKSGYGSFYYGLDV

SEQ ID NO: 1193 - DNA, 324 bp, Artificial Sequence
  Description of Artificial Sequence: Synthetic polynucleotide
gaaatagtgttgacacagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 1194 - protein, 108 aa, Artificial Sequence; identical to SEQ ID NO: 1162
  Description of Artificial Sequence: Synthetic polypeptide

SEQ ID NO: 1195 - DNA, 21 bp, Artificial Sequence
  Description of Artificial Sequence: Synthetic oligonucleotide
cagagtattagaagcatctac

SEQ ID NO: 1196 - protein, 7 aa, Artificial Sequence
  Description of Artificial Sequence: Synthetic peptide
QSIRSIY

SEQ ID NO: 1197 - DNA, 9 bp, Artificial Sequence
  Description of Artificial Sequence: Synthetic oligonucleotide
ggtgcgtcc

SEQ ID NO: 1198 - protein, 3 aa, Artificial Sequence
  Description of Artificial Sequence: Synthetic peptide
GAS

SEQ ID NO: 1199 - DNA, 27 bp, Artificial Sequence
  Description of Artificial Sequence: Synthetic oligonucleotide
cagcagcgtgttagctcaccgtacact

SEQ ID NO: 1200 - protein, 9 aa, Artificial Sequence
  Description of Artificial Sequence: Synthetic peptide
QQRVSSPYT

SEQ ID NO: 1201 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgatttcaccatgcactgggtccggcaagctccaggaaagggcctggagtgggtctcagatattagttggaatagtggtagcatagactatgcggactctgtgaagggccgattcaccatttccagagacaatgccaggaactccctgtttctacaaatgagcagtctgagaactgaggacacggcctcgtattactgtataaaagataagagtggctacggctcctacaactacggtctggacgtctggggccaagggaccacggtcaccgtctcctca

SEQ ID NO: 1202 - protein, 123 aa, Artificial Sequence
  Description of Artificial Sequence: Synthetic polypeptide
EVQLVESGGGLVQPGRSLRLSCAASGFTFDDFTMHWVRQAPGKGLEWVSDISWNSGSIDYADSVKGRFTISRDNARNSLFLQMSSLRTEDTASYYCIKDKSGYGSYNYGLDVWGQGTTVTVSS

SEQ ID NO: 1203 - DNA, 24 bp, Artificial Sequence
  Description of Artificial Sequence: Synthetic oligonucleotide
ggattcacctttgatgatttcacc

SEQ ID NO: 1204 - protein, 8 aa, Artificial Sequence
  Description of Artificial Sequence: Synthetic peptide
GFTFDDFT

SEQ ID NO: 1205 - DNA, 24 bp, Artificial Sequence
  Description of Artificial Sequence: Synthetic oligonucleotide
attagttggaatagtggtagcata

SEQ ID NO: 1206 - protein, 8 aa, Artificial Sequence
  Description of Artificial Sequence: Synthetic peptide
ISWNSGSI

SEQ ID NO: 1207 - DNA, 48 bp, Artificial Sequence
  Description of Artificial Sequence: Synthetic oligonucleotide
ataaaagataagagtggctacggctcctacaactacggtctggacgtc

SEQ ID NO: 1208 - protein, 16 aa, Artificial Sequence
  Description of Artificial Sequence: Synthetic peptide
IKDKSGYGSYNYGLDV

SEQ ID NO: 1209 - DNA, 324 bp, Artificial Sequence
  Description of Artificial Sequence: Synthetic polynucleotide
gaaattgtgttgacgcagtctccaggcaccctgtctttgtctccaggggacagagccaccctctcctgcagggccagtcagagtgttagcagcatctacttagcctggtaccagcagaaacctggccaggctcccaggctcctcatccatggtgcgtccaccagggccactggcatcccagacaggttcagtggcagtgggtcggggacagacttcactctcaccatcagcagactggagcctgaagattttgcactttattactgtcaccagcgtgttagttcaccgtacacttttggccaggggaccaagctggagatcaaa

SEQ ID NO: 1210 - protein, 108 aa, Artificial Sequence
  Description of Artificial Sequence: Synthetic polypeptide
EIVLTQSPGTLSLSPGDRATLSCRASQSVSSIYLAWYQQKPGQAPRLLIHGASTRATGIPDRFSGSGSGTDFTLTISRLEPEDFALYYCHQRVSSPYTFGQGTKLEIK

SEQ ID NO: 1211 - DNA, 21 bp, Artificial Sequence
  Description of Artificial Sequence: Synthetic oligonucleotide
cagagtgttagcagcatctac

SEQ ID NO: 1212 - protein, 7 aa, Artificial Sequence
  Description of Artificial Sequence: Synthetic peptide
QSVSSIY

SEQ ID NO: 1213 - DNA, 9 bp, Artificial Sequence
  Description of Artificial Sequence: Synthetic oligonucleotide
ggtgcgtcc

SEQ ID NO: 1214 - protein, 3 aa, Artificial Sequence
  Description of Artificial Sequence: Synthetic peptide
GAS

SEQ ID NO: 1215 - DNA, 27 bp, Artificial Sequence
  Description of Artificial Sequence: Synthetic oligonucleotide
caccagcgtgttagttcaccgtacact

SEQ ID NO: 1216 - protein, 9 aa, Artificial Sequence
  Description of Artificial Sequence: Synthetic peptide
HQRVSSPYT

SEQ ID NO: 1217 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagtaaagactatgcggactctgtgaagggccgattcaccatctccagagacaacaccaggaactccctgtttctgcaaatgaacagtctgagaactgaagacacggccttatattactgtgcaaaagataagagtggctacggctccttctactacggtatggacgtctggggccaagggaccacggtcaccgtctcctca

SEQ ID NO: 1218 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSKDYADSVKGRFTISRDNTRNSLFLQMNSLRTEDTALYYCAKDKSGYGSFYYGMDVWGQGTTVTVSS

SEQ ID NO: 1219 - DNA, 24 bp, Artificial Sequence
  Description of Artificial Sequence: Synthetic oligonucleotide
ggattcacctttgatgattatgcc

SEQ ID NO: 1220 - protein, 8 aa, Artificial Sequence
  Description of Artificial Sequence: Synthetic peptide
GFTFDDYA

SEQ ID NO: 1221 - DNA, 24 bp, Artificial Sequence
  Description of Artificial Sequence: Synthetic oligonucleotide
attagttggaatagtggtagtaaa

SEQ ID NO: 1222 - protein, 8 aa, Artificial Sequence
  Description of Artificial Sequence: Synthetic peptide
ISWNSGSK

SEQ ID NO: 1223 - DNA, 48 bp, Artificial Sequence; identical to SEQ ID NO: 1111
  Description of Artificial Sequence: Synthetic oligonucleotide

SEQ ID NO: 1224 - protein, 16 aa, Artificial Sequence
  Description of Artificial Sequence: Synthetic peptide
AKDKSGYGSFYYGMDV

SEQ ID NO: 1225 - DNA, 318 bp, Artificial Sequence
  Description of Artificial Sequence: Synthetic polynucleotide
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccgttcggccaagggaccaaggtggaaatcaaa

SEQ ID NO: 1226 - protein, 106 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSPFGQGTKVEIK

SEQ ID NO: 1227 - DNA, 18 bp, Artificial Sequence
  Description of Artificial Sequence: Synthetic oligonucleotide
cagagtattagtagctgg

SEQ ID NO: 1228 - protein, 6 aa, Artificial Sequence
  Description of Artificial Sequence: Synthetic peptide
QSISSW

SEQ ID NO: 1229 - DNA, 9 bp, Artificial Sequence
  Description of Artificial Sequence: Synthetic oligonucleotide
aaggcgtct

SEQ ID NO: 1230 - protein, 3 aa, Artificial Sequence
  Description of Artificial Sequence: Synthetic peptide
KAS

SEQ ID NO: 1231 - DNA, 24 bp, Artificial Sequence
  Description of Artificial Sequence: Synthetic oligonucleotide
caacagtataatagttattctccg

SEQ ID NO: 1232 - protein, 8 aa, Artificial Sequence
  Description of Artificial Sequence: Synthetic peptide
QQYNSYSP

SEQ ID NO: 1233 - DNA, 372 bp, Artificial Sequence
  Description of Artificial Sequence: Synthetic polynucleotide
caggtgcaactggtggagtctgggggaggcgtggtccagcctgggaggtccctgagactctcctgtgcagcctctggactcaccttcagtacctatgtcatgcactgggtccgccaggctccaggcaaggggctggcgtgggtggcagttatagcaaatgatggaagtaataaatattatgcagactccgtgaagggccgattcaccatctccagagacaactccaagaacacgctgtatctgcaaatgaatagcctgagacctgaggacacggctgtgtatttttgtgcgaaagaggggggtaccagtgggtcctactattactatggaatggacgtctggggtcaagggactacggtcaccgtctcctca

SEQ ID NO: 1234 - protein, 124 aa, Artificial Sequence
  Description of Artificial Sequence: Synthetic polypeptide
QVQLVESGGGVVQPGRSLRLSCAASGLTFSTYVMHWVRQAPGKGLAWVAVIANDGSNKYYADSVKGRFTISRDNSKNTLYLQMNSLRPEDTAVYFCAKEGGTSGSYYYYGMDVWGQGTTVTVSS

SEQ ID NO: 1235 - DNA, 24 bp, Artificial Sequence
  Description of Artificial Sequence: Synthetic oligonucleotide
ggactcaccttcagtacctatgtc

SEQ ID NO: 1236 - protein, 8 aa, Artificial Sequence
  Description of Artificial Sequence: Synthetic peptide
GLTFSTYV

SEQ ID NO: 1237 - DNA, 24 bp, Artificial Sequence
  Description of Artificial Sequence: Synthetic oligonucleotide
atagcaaatgatggaagtaataaa

SEQ ID NO: 1238 - protein, 8 aa, Artificial Sequence
  Description of Artificial Sequence: Synthetic peptide
IANDGSNK

SEQ ID NO: 1239 - DNA, 51 bp, Artificial Sequence
  Description of Artificial Sequence: Synthetic oligonucleotide
gcgaaagaggggggtaccagtgggtcctactattactatggaatggacgtc

SEQ ID NO: 1240 - protein, 17 aa, Artificial Sequence
  Description of Artificial Sequence: Synthetic peptide
AKEGGTSGSYYYYGMDV

SEQ ID NO: 1241 - DNA, 342 bp, Artificial Sequence
  Description of Artificial Sequence: Synthetic polynucleotide
gacatccagatgacccagtctccagactccctggctgtgtctctgggcgagagggccaccatcaactgcaagtccagccagagtcttttattcaactccatcaataagaactacttagcttggtaccagcagaaaccaggacagcctcctaagcttctcctttactgggcatctacccgggaatccgggatccctgaccgattcagtggcagcgggtctgggacagatttcactctcaccatcaccagcctgcaggctgaagatgtggcactttattactgtcagcaatattatagtattccgtggacgttcggccaagggaccaaggtggaaatcaaacga

SEQ ID NO: 1242 - protein, 114 aa, Artificial Sequence
  Description of Artificial Sequence: Synthetic polypeptide
DIQMTQSPDSLAVSLGERATINCKSSQSLLFNSINKNYLAWYQQKPGQPPKLLLYWASTRESGIPDRFSGSGSGTDFTLTITSLQAEDVALYYCQQYYSIPWTFGQGTKVEIKR

SEQ ID NO: 1243 - DNA, 36 bp, Artificial Sequence
  Description of Artificial Sequence: Synthetic oligonucleotide
cagagtcttttattcaactccatcaataagaactac

SEQ ID NO: 1244 - protein, 12 aa, Artificial Sequence
  Description of Artificial Sequence: Synthetic peptide
QSLLFNSINKNY

SEQ ID NO: 1245 - DNA, 9 bp, Artificial Sequence
  Description of Artificial Sequence: Synthetic oligonucleotide
tgggcatct

SEQ ID NO: 1246 - protein, 3 aa, Artificial Sequence
  Description of Artificial Sequence: Synthetic peptide
WAS

SEQ ID NO: 1247 - DNA, 27 bp, Artificial Sequence
  Description of Artificial Sequence: Synthetic oligonucleotide
cagcaatattatagtattccgtggacg

SEQ ID NO: 1248 - protein, 9 aa, Artificial Sequence
  Description of Artificial Sequence: Synthetic peptide
QQYYSIPWT

SEQ ID NO: 1249 - DNA, 354 bp, Artificial Sequence
  Description of Artificial Sequence: Synthetic polynucleotide
caggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1250 - protein, 118 aa, Artificial Sequence
  Description of Artificial Sequence: Synthetic polypeptide
QVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1251 - DNA, 24 bp, Artificial Sequence
  Description of Artificial Sequence: Synthetic oligonucleotide
ggatacaccttcaccggctactat

SEQ ID NO: 1252 - protein, 8 aa, Artificial Sequence
  Description of Artificial Sequence: Synthetic peptide
GYTFTGYY

SEQ ID NO: 1253 - DNA, 24 bp, Artificial Sequence
  Description of Artificial Sequence: Synthetic oligonucleotide
atcaaccctaaaagtggtggcaca

SEQ ID NO: 1254 - protein, 8 aa, Artificial Sequence
  Description of Artificial Sequence: Synthetic peptide
INPKSGGT

SEQ ID NO: 1255 - DNA, 33 bp, Artificial Sequence
  Description of Artificial Sequence: Synthetic oligonucleotide
gcgagaatgggggacggtgcagtgtttgacttc

SEQ ID NO: 1256 - protein, 11 aa, Artificial Sequence
  Description of Artificial Sequence: Synthetic peptide
ARMGDGAVFDF

SEQ ID NO: 1257 - DNA, 324 bp, Artificial Sequence
  Description of Artificial Sequence: Synthetic polynucleotide
gccatccagatgacccagtctccatcctccctgtctgcatctgtaggagacagagtcaccatcacttgccgggcaagtcagaggattagcagctttttaaattggtatcagcagaaaccagggaaagcccctaagctcctgatctatactgcatccaatttacaaaatggggtcccatcaaggttcagtggcagtggatctgggacagatttcactctcactatcagcagtctgcaacctgaagattttgctacttactactgtcaacagagttacaggaccccgctcactttcggcggagggaccaaggtggaaatcaaacga

SEQ ID NO: 1258 - protein, 108 aa, Artificial Sequence
  Description of Artificial Sequence: Synthetic polypeptide
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKVEIKR

SEQ ID NO: 1259 - DNA, 18 bp, Artificial Sequence
  Description of Artificial Sequence: Synthetic oligonucleotide
cagaggattagcagcttt

SEQ ID NO: 1260 - protein, 6 aa, Artificial Sequence
  Description of Artificial Sequence: Synthetic peptide
QRISSF

SEQ ID NO: 1261 - DNA, 9 bp, Artificial Sequence
  Description of Artificial Sequence: Synthetic oligonucleotide
actgcatcc

SEQ ID NO: 1262 - protein, 3 aa, Artificial Sequence
  Description of Artificial Sequence: Synthetic peptide
TAS

SEQ ID NO: 1263 - DNA, 27 bp, Artificial Sequence
  Description of Artificial Sequence: Synthetic oligonucleotide
caacagagttacaggaccccgctcact

SEQ ID NO: 1264 - protein, 9 aa, Artificial Sequence
  Description of Artificial Sequence: Synthetic peptide
QQSYRTPLT

SEQ ID NO: 1265 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaacagtggtagcataggctatgcggactctgtgaagggccgattcaccatttccagagacaacgccaagaactccctgtatttgcaaatgaacagtctgagagctgaggacacggccttgttttactgtgcaaaagatcaaagtggttacggccactactactacggtatggacgtctggggccaagggaccacggtcaccgtctcctca

SEQ ID NO: 1266 - protein, 123 aa, Artificial Sequence
  Description of Artificial Sequence: Synthetic polypeptide
EVQLVESGGGLVQPGRSLRLSCAASGFTFDDYTMHWVRQAPGKGLEWVSGISWNSGSIGYADSVKGRFTISRDNAKNSLYLQMNSLRAEDTALFYCAKDQSGYGHYYYGMDVWGQGTTVTVSS

SEQ ID NO: 1267 - DNA, 24 bp, Artificial Sequence
  Description of Artificial Sequence: Synthetic oligonucleotide
ggattcacctttgatgattatacc

SEQ ID NO: 1268 - protein, 8 aa, Artificial Sequence
  Description of Artificial Sequence: Synthetic peptide
GFTFDDYT

SEQ ID NO: 1269 - DNA, 24 bp, Artificial Sequence
  Description of Artificial Sequence: Synthetic oligonucleotide
attagttggaacagtggtagcata

SEQ ID NO: 1270 - protein, 8 aa, Artificial Sequence
  Description of Artificial Sequence: Synthetic peptide
ISWNSGSI

SEQ ID NO: 1271 - DNA, 48 bp, Artificial Sequence
  Description of Artificial Sequence: Synthetic oligonucleotide
gcaaaagatcaaagtggttacggccactactactacggtatggacgtc

SEQ ID NO: 1272 - protein, 16 aa, Artificial Sequence
  Description of Artificial Sequence: Synthetic peptide
AKDQSGYGHYYYGMDV

SEQ ID NO: 1273 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgtagggccagtcagagtgttagcagcaacttagcctggtaccagcagaaacctggccaggctcccaggctcctcatctatggtgcatccaccagggccactgatatcccagccaggttcagtggcagtgggtctgggacagagttcactctcaccatcagcagcctgcagtctgaagattttgcagtttatcactgtcagcagtataataactggccgctcactttcggcggagggaccaaggtggagatcaaa

SEQ ID NO: 1274 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATDIPARFSGSGSGTEFTLTISSLQSEDFAVYHCQQYNNWPLTFGGGTKVEIK

SEQ ID NO: 1275 - DNA, 18 bp, Artificial Sequence
  Description of Artificial Sequence: Synthetic oligonucleotide
cagagtgttagcagcaac

SEQ ID NO: 1276 - protein, 6 aa, Artificial Sequence
  Description of Artificial Sequence: Synthetic peptide
QSVSSN

SEQ ID NO: 1277 - DNA, 9 bp, Artificial Sequence
  Description of Artificial Sequence: Synthetic oligonucleotide
ggtgcatcc

SEQ ID NO: 1278 - protein, 3 aa, Artificial Sequence
  Description of Artificial Sequence: Synthetic peptide
GAS

SEQ ID NO: 1279 - DNA, 27 bp, Artificial Sequence
  Description of Artificial Sequence: Synthetic oligonucleotide
cagcagtataataactggccgctcact

SEQ ID NO: 1280 - protein, 9 aa, Artificial Sequence
  Description of Artificial Sequence: Synthetic peptide
QQYNNWPLT

SEQ ID NO: 1281 - DNA, 387 bp, Artificial Sequence
  Description of Artificial Sequence: Synthetic polynucleotide
gaggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcagttatatcatttgatggaaagaataaatattatgcagactccgtgatgggccgattcaccatctccagagacaattccaagaatacactgtatctgcaaatgaacagcctgagagctgaggactcggctgtgtttttctgtgcgaggtcttacgacattttgactggttatggagccggttacagctaccactacggtatggacgtctggggccaagggaccacggtcaccgtctcctca

SEQ ID NO: 1282 - protein, 129 aa, Artificial Sequence
  Description of Artificial Sequence: Synthetic polypeptide
EVQLVESGGGVVQPGRSLRLSCAASGFTFSYYGMHWVRQAPGKGLEWVAVISFDGKNKYYADSVMGRFTISRDNSKNTLYLQMNSLRAEDSAVFFCARSYDILTGYGAGYSYHYGMDVWGQGTTVTVSS

SEQ ID NO: 1283 - DNA, 24 bp, Artificial Sequence
  Description of Artificial Sequence: Synthetic oligonucleotide
ggattcaccttcagttactatggc

SEQ ID NO: 1284 - protein, 8 aa, Artificial Sequence
  Description of Artificial Sequence: Synthetic peptide
GFTFSYYG

SEQ ID NO: 1285 - DNA, 24 bp, Artificial Sequence
  Description of Artificial Sequence: Synthetic oligonucleotide
atatcatttgatggaaagaataaa

SEQ ID NO: 1286 - protein, 8 aa, Artificial Sequence
  Description of Artificial Sequence: Synthetic peptide
ISFDGKNK

SEQ ID NO: 1287 - DNA, 66 bp, Artificial Sequence
  Description of Artificial Sequence: Synthetic oligonucleotide
gcgaggtcttacgacattttgactggttatggagccggttacagctaccactacggtatggacgtc

SEQ ID NO: 1288 - protein, 22 aa, Artificial Sequence
  Description of Artificial Sequence: Synthetic peptide
ARSYDILTGYGAGYSYHYGMDV

SEQ ID NO: 1289 - DNA, 324 bp, Artificial Sequence
  Description of Artificial Sequence: Synthetic polynucleotide
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaaggtggagatcaaacga

SEQ ID NO: 1290 - protein, 108 aa, Artificial Sequence; identical to SEQ ID NO: 1258
  Description of Artificial Sequence: Synthetic polypeptide

SEQ ID NO: 1291 - DNA, 18 bp, Artificial Sequence
  Description of Artificial Sequence: Synthetic oligonucleotide
cagaggattagcagcttt

SEQ ID NO: 1292 - protein, 6 aa, Artificial Sequence
  Description of Artificial Sequence: Synthetic peptide
QRISSF

SEQ ID NO: 1293 - DNA, 9 bp, Artificial Sequence
  Description of Artificial Sequence: Synthetic oligonucleotide
actgcatcc

SEQ ID NO: 1294 - protein, 3 aa, Artificial Sequence
  Description of Artificial Sequence: Synthetic peptide
TAS

SEQ ID NO: 1295 - DNA, 27 bp, Artificial Sequence
  Description of Artificial Sequence: Synthetic oligonucleotide
caacagagttacaggaccccgctcact

SEQ ID NO: 1296 - protein, 9 aa, Artificial Sequence
  Description of Artificial Sequence: Synthetic peptide
QQSYRTPLT

SEQ ID NO: 1297 - DNA, 354 bp, Artificial Sequence
  Description of Artificial Sequence: Synthetic polynucleotide
caggtgcagctggtggagtctggggctgaagtgaagaagcctggggcctcagtgaaggtctcctgcaagacttctggatacaccctctccggctattatatgcactggatgcgacaggcccctggacaagggcttgagtggatgggatggattaaccctaaaagtggtgtcacaaattatgcacagaagtttcaggacagagtcgccatgaccagggacacgtccatcagcacagcctacatggaactgagcaggctgagatctgacgacacggccgtgtattactgtgcgagaatgggggacggtgcagtgtttgacttctgggcccagggaaccctggtcaccgtctcctca

SEQ ID NO: 1298 - protein, 118 aa, Artificial Sequence
  Description of Artificial Sequence: Synthetic polypeptide
QVQLVESGAEVKKPGASVKVSCKTSGYTLSGYYMHWMRQAPGQGLEWMGWINPKSGVTNYAQKFQDRVAMTRDTSISTAYMELSRLRSDDTAVYYCARMGDGAVFDFWAQGTLVTVSS

SEQ ID NO: 1299 - DNA, 24 bp, Artificial Sequence
  Description of Artificial Sequence: Synthetic oligonucleotide
ggatacaccctctccggctattat

SEQ ID NO: 1300 - protein, 8 aa, Artificial Sequence
  Description of Artificial Sequence: Synthetic peptide
GYTLSGYY

SEQ ID NO: 1301 - DNA, 24 bp, Artificial Sequence
  Description of Artificial Sequence: Synthetic oligonucleotide
attaaccctaaaagtggtgtcaca

SEQ ID NO: 1302 - protein, 8 aa, Artificial Sequence
  Description of Artificial Sequence: Synthetic peptide
INPKSGVT

SEQ ID NO: 1303 - DNA, 33 bp, Artificial Sequence; identical to SEQ ID NO: 1255
  Description of Artificial Sequence: Synthetic oligonucleotide

SEQ ID NO: 1304 - protein, 11 aa, Artificial Sequence
  Description of Artificial Sequence: Synthetic peptide
ARMGDGAVFDF

SEQ ID NO: 1305 - DNA, 324 bp, Artificial Sequence
  Description of Artificial Sequence: Synthetic polynucleotide
gacatccagttgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1306 - protein, 108 aa, Artificial Sequence
  Description of Artificial Sequence: Synthetic polypeptide
DIQLTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1307 - DNA, 18 bp, Artificial Sequence
  Description of Artificial Sequence: Synthetic oligonucleotide
cagaggattagcagcttt

SEQ ID NO: 1308 - protein, 6 aa, Artificial Sequence
  Description of Artificial Sequence: Synthetic peptide
QRISSF

SEQ ID NO: 1309 - DNA, 9 bp, Artificial Sequence
  Description of Artificial Sequence: Synthetic oligonucleotide
actgcatcc

SEQ ID NO: 1310 - protein, 3 aa, Artificial Sequence
  Description of Artificial Sequence: Synthetic peptide
TAS

SEQ ID NO: 1311 - DNA, 27 bp, Artificial Sequence
  Description of Artificial Sequence: Synthetic oligonucleotide
caacagagttacaggaccccgctcact

SEQ ID NO: 1312 - protein, 9 aa, Artificial Sequence
  Description of Artificial Sequence: Synthetic peptide
QQSYRTPLT

SEQ ID NO: 1313 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgtcaactatatcatttgatggaagtaacaaatactatgcagactccgtgaagggccgattcaccatctccagagacaattccaagaacacgctgtatctgcaaatgaacagcctgagacctgaggacacggctgtgtattactgtgcgaaaggggggggtaccagtgggtcctacttttactacggtatggacgtctggggccaagggaccacggtcaccgtctcctca

SEQ ID NO: 1314 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVSTISFDGSNKYYADSVKGRFTISRDNSKNTLYLQMNSLRPEDTAVYYCAKGGGTSGSYFYYGMDVWGQGTTVTVSS

SEQ ID NO: 1315 - DNA, 24 bp, Artificial Sequence
  Description of Artificial Sequence: Synthetic oligonucleotide
ggattcaccttcagtagctatggc

SEQ ID NO: 1316 - protein, 8 aa, Artificial Sequence
  Description of Artificial Sequence: Synthetic peptide
GFTFSSYG

SEQ ID NO: 1317 - DNA, 24 bp, Artificial Sequence
  Description of Artificial Sequence: Synthetic oligonucleotide
atatcatttgatggaagtaacaaa

SEQ ID NO: 1318 - protein, 8 aa, Artificial Sequence
  Description of Artificial Sequence: Synthetic peptide
ISFDGSNK

SEQ ID NO: 1319 - DNA, 51 bp, Artificial Sequence
  Description of Artificial Sequence: Synthetic oligonucleotide
gcgaaaggggggggtaccagtgggtcctacttttactacggtatggacgtc

SEQ ID NO: 1320 - protein, 17 aa, Artificial Sequence
  Description of Artificial Sequence: Synthetic peptide
AKGGGTSGSYFYYGMDV

SEQ ID NO: 1321 - DNA, 324 bp, Artificial Sequence
  Description of Artificial Sequence: Synthetic polynucleotide
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1322 - protein, 108 aa, Artificial Sequence
  Description of Artificial Sequence: Synthetic polypeptide
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1323 - DNA, 18 bp, Artificial Sequence
  Description of Artificial Sequence: Synthetic oligonucleotide
cagaggattagcagcttt

SEQ ID NO: 1324 - protein, 6 aa, Artificial Sequence
  Description of Artificial Sequence: Synthetic peptide
QRISSF

SEQ ID NO: 1325 - DNA, 9 bp, Artificial Sequence
  Description of Artificial Sequence: Synthetic oligonucleotide
actgcatcc

SEQ ID NO: 1326 - protein, 3 aa, Artificial Sequence
  Description of Artificial Sequence: Synthetic peptide
TAS

SEQ ID NO: 1327 - DNA, 27 bp, Artificial Sequence
  Description of Artificial Sequence: Synthetic oligonucleotide
caacagagttacaggaccccgctcact

SEQ ID NO: 1328 - protein, 9 aa, Artificial Sequence
  Description of Artificial Sequence: Synthetic peptide
QQSYRTPLT

SEQ ID NO: 1329 - DNA, 354 bp, Artificial Sequence
  Description of Artificial Sequence: Synthetic polynucleotide
caggttcagctggtgcagtctgggactgaggtgaagaagcctggggcctcaatgaaggtctcctgcaaggcttctggatacaccttcaccggctactatattcactgggtgcgacaggcccctggacaagggcttgagtggatgggatggatcaaccctaacagtgatgtcacaaagtatgcacagaagtttcagggcagggtcaccttgaccagggacacgtccatcagtgcagcctatattgacctgagcaggctgagatctgacgacacggccatttattactgtgcgagaatgggggacggtgcagtgtttgactactggggccagggaaccctggtcaccgtctcctca

SEQ ID NO: 1330 - protein, 118 aa, Artificial Sequence
  Description of Artificial Sequence: Synthetic polypeptide
QVQLVQSGTEVKKPGASMKVSCKASGYTFTGYYIHWVRQAPGQGLEWMGWINPNSDVTKYAQKFQGRVTLTRDTSISAAYIDLSRLRSDDTAIYYCARMGDGAVFDYWGQGTLVTVSS

SEQ ID NO: 1331 - DNA, 24 bp, Artificial Sequence
  Description of Artificial Sequence: Synthetic oligonucleotide
ggatacaccttcaccggctactat

SEQ ID NO: 1332 - protein, 8 aa, Artificial Sequence
  Description of Artificial Sequence: Synthetic peptide
GYTFTGYY

SEQ ID NO: 1333 - DNA, 24 bp, Artificial Sequence
  Description of Artificial Sequence: Synthetic oligonucleotide
atcaaccctaacagtgatgtcaca

SEQ ID NO: 1334 - protein, 8 aa, Artificial Sequence
  Description of Artificial Sequence: Synthetic peptide
INPNSDVT

SEQ ID NO: 1335 - DNA, 33 bp, Artificial Sequence
  Description of Artificial Sequence: Synthetic oligonucleotide
gcgagaatgggggacggtgcagtgtttgactac

SEQ ID NO: 1336 - protein, 11 aa, Artificial Sequence
  Description of Artificial Sequence: Synthetic peptide
ARMGDGAVFDY

SEQ ID NO: 1337 - DNA, 324 bp, Artificial Sequence
  Description of Artificial Sequence: Synthetic polynucleotide
gacatccagttgacccagtctccatcctccctgtctgcatctgtaggagacagagtcaccatcacttgccgggcaagtcaacgcattagcagctatttaaattggtatcaacagaaaccagggaaagcccctaaggtgctgatctctgttgcatccagtttacaaagtggggtcccatcaaggttcagtggcagtggatttgggacagatttcactctcaccatcagcagtctgcaacctgaggattctgcatcttactactgtcaacagagttacaataccccgctcactttcggcggcgggaccaagctggagatcaaacga

SEQ ID NO: 1338 - protein, 108 aa, Artificial Sequence
  Description of Artificial Sequence: Synthetic polypeptide
DIQLTQSPSSLSASVGDRVTITCRASQRISSYLNWYQQKPGKAPKVLISVASSLQSGVPSRFSGSGFGTDFTLTISSLQPEDSASYYCQQSYNTPLTFGGGTKLEIKR

SEQ ID NO: 1339 - DNA, 18 bp, Artificial Sequence
  Description of Artificial Sequence: Synthetic oligonucleotide
caacgcattagcagctat

SEQ ID NO: 1340 - protein, 6 aa, Artificial Sequence
  Description of Artificial Sequence: Synthetic peptide
QRISSY

SEQ ID NO: 1341 - DNA, 9 bp, Artificial Sequence
  Description of Artificial Sequence: Synthetic oligonucleotide
gttgcatcc

SEQ ID NO: 1342 - protein, 3 aa, Artificial Sequence
  Description of Artificial Sequence: Synthetic peptide
VAS

SEQ ID NO: 1343 - DNA, 27 bp, Artificial Sequence
  Description of Artificial Sequence: Synthetic oligonucleotide
caacagagttacaataccccgctcact

SEQ ID NO: 1344 - protein, 9 aa, Artificial Sequence
  Description of Artificial Sequence: Synthetic peptide
QQSYNTPLT

SEQ ID NO: 1345 - DNA, 354 bp, Artificial Sequence
  Description of Artificial Sequence: Synthetic polynucleotide
gaggtgcagctggtggagtctggggctgaagtgaagaagcctggggcctcagtgaaggtctcctgcaagacttctggatacagtttcattggctattatatacactggatgcgacaggcccctggacaagggcttgaatggatgggatggatcaaccctaagagtggtgtcacaaattatgcacagaggtttcagggcagggtcaccatgaccagggacacgtccatcagtactgcctacatggaactgagcaggctgaaatctgacgacacggccgtgtatttctgtgcgagaatgggggacggtgcagtgtttgacttctggggccagggaaccctggtcaccgtctcctca

SEQ ID NO: 1346 - protein, 118 aa, Artificial Sequence
  Description of Artificial Sequence: Synthetic polypeptide
EVQLVESGAEVKKPGASVKVSCKTSGYSFIGYYIHWMRQAPGQGLEWMGWINPKSGVTNYAQRFQGRVTMTRDTSISTAYMELSRLKSDDTAVYFCARMGDGAVFDFWGQGTLVTVSS

SEQ ID NO: 1347 - DNA, 24 bp, Artificial Sequence
  Description of Artificial Sequence: Synthetic oligonucleotide
ggatacagtttcattggctattat

SEQ ID NO: 1348 - protein, 8 aa, Artificial Sequence
  Description of Artificial Sequence: Synthetic peptide
GYSFIGYY

SEQ ID NO: 1349 - DNA, 24 bp, Artificial Sequence
  Description of Artificial Sequence: Synthetic oligonucleotide
atcaaccctaagagtggtgtcaca

SEQ ID NO: 1350 - protein, 8 aa, Artificial Sequence
  Description of Artificial Sequence: Synthetic peptide
INPKSGVT

SEQ ID NO: 1351 - DNA, 33 bp, Artificial Sequence; identical to SEQ ID NO: 1255
  Description of Artificial Sequence: Synthetic oligonucleotide

SEQ ID NO: 1352 - protein, 11 aa, Artificial Sequence
  Description of Artificial Sequence: Synthetic peptide
ARMGDGAVFDF

SEQ ID NO: 1353 - DNA, 324 bp, Artificial Sequence
  Description of Artificial Sequence: Synthetic polynucleotide
gacatccagttgacccagtctccatcctccctgtctgcatctgtaggagacagagtcaccatcacttgccgggcaagtcagaggattagcagctttttaaattggtatcagcagaaaccagggaaagtccctaagctcctgatctatactgcatccaatttacaaaatggggtcccatcaaggttcagtggcactggatctgggacagatttcactctcaccatcagcagtctgcaacctgaagattttgcaacttactactgtcaacagagttacaggaccccgctcactttcggcggagggaccaaagtggatatcaaacga

SEQ ID NO: 1354 - protein, 108 aa, Artificial Sequence
  Description of Artificial Sequence: Synthetic polypeptide
DIQLTQSPSSLSASVGDRVTITCRASQRISSFLNWYQQKPGKVPKLLIYTASNLQNGVPSRFSGTGSGTDFTLTISSLQPEDFATYYCQQSYRTPLTFGGGTKVDIKR

SEQ ID NO: 1355 - DNA, 18 bp, Artificial Sequence
  Description of Artificial Sequence: Synthetic oligonucleotide
cagaggattagcagcttt

SEQ ID NO: 1356 - protein, 6 aa, Artificial Sequence
  Description of Artificial Sequence: Synthetic peptide
QRISSF

SEQ ID NO: 1357 - DNA, 9 bp, Artificial Sequence
  Description of Artificial Sequence: Synthetic oligonucleotide
actgcatcc

SEQ ID NO: 1358 - protein, 3 aa, Artificial Sequence
  Description of Artificial Sequence: Synthetic peptide
TAS

SEQ ID NO: 1359 - DNA, 27 bp, Artificial Sequence
  Description of Artificial Sequence: Synthetic oligonucleotide
caacagagttacaggaccccgctcact

SEQ ID NO: 1360 - protein, 9 aa, Artificial Sequence
  Description of Artificial Sequence: Synthetic peptide
QQSYRTPLT

SEQ ID NO: 1361 - DNA, 354 bp, Artificial Sequence
  Description of Artificial Sequence: Synthetic polynucleotide
gaggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1362 - protein, 118 aa, Artificial Sequence
  Description of Artificial Sequence: Synthetic polypeptide
EVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1363 - DNA, 24 bp, Artificial Sequence
  Description of Artificial Sequence: Synthetic oligonucleotide
ggatacaccttcaccggctactat

SEQ ID NO: 1364 - protein, 8 aa, Artificial Sequence
  Description of Artificial Sequence: Synthetic peptide
GYTFTGYY

SEQ ID NO: 1365 - DNA, 24 bp, Artificial Sequence
  Description of Artificial Sequence: Synthetic oligonucleotide
atcaaccctaaaagtggtggcaca

SEQ ID NO: 1366 - protein, 8 aa, Artificial Sequence
  Description of Artificial Sequence: Synthetic peptide
INPKSGGT

SEQ ID NO: 1367 - DNA, 33 bp, Artificial Sequence; identical to SEQ ID NO: 1255
  Description of Artificial Sequence: Synthetic oligonucleotide

SEQ ID NO: 1368 - protein, 11 aa, Artificial Sequence
  Description of Artificial Sequence: Synthetic peptide
ARMGDGAVFDF

SEQ ID NO: 1369 - DNA, 327 bp, Artificial Sequence
  Description of Artificial Sequence: Synthetic polynucleotide
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaagtggatatcaaacga

SEQ ID NO: 1370 - protein, 109 aa, Artificial Sequence
  Description of Artificial Sequence: Synthetic polypeptide
DIVMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVDIKR

SEQ ID NO: 1371 - DNA, 18 bp, Artificial Sequence
  Description of Artificial Sequence: Synthetic oligonucleotide
cagagcattagcagctat

SEQ ID NO: 1372 - protein, 6 aa, Artificial Sequence
  Description of Artificial Sequence: Synthetic peptide
QSISSY

SEQ ID NO: 1373 - DNA, 9 bp, Artificial Sequence
  Description of Artificial Sequence: Synthetic oligonucleotide
gctgcatcc

SEQ ID NO: 1374 - protein, 3 aa, Artificial Sequence
  Description of Artificial Sequence: Synthetic peptide
AAS

SEQ ID NO: 1375 - DNA, 30 bp, Artificial Sequence
  Description of Artificial Sequence: Synthetic oligonucleotide
caacagagttacagtacccctccgctcact

SEQ ID NO: 1376 - protein, 10 aa, Artificial Sequence
  Description of Artificial Sequence: Synthetic peptide
QQSYSTPPLT

SEQ ID NO: 1377 - DNA, 354 bp, Artificial Sequence
  Description of Artificial Sequence: Synthetic polynucleotide
caggttcagctggtgcagtctgggactgaggtgaagaagcctggggcctcagtgaaggtctcctgcaaggcttctggatacaccttcaccggctactatatgcactgggtgcgacaggcccctggacaagggcttgagtggatgggatggatcaaccctaacagtgatgtcacaaactatgcacagaagtttcagggcagggtcaccttgaccagggacacgtccatcagtacagcctacattgacctgagcaggctgagatctgacgacacggccatttattactgtgcgagaatgggggacggtgcagtgtttgactactggggccagggaaccctggtcaccgtctcctca

SEQ ID NO: 1378 - protein, 118 aa, Artificial Sequence
  Description of Artificial Sequence: Synthetic polypeptide
QVQLVQSGTEVKKPGASVKVSCKASGYTFTGYYMHWVRQAPGQGLEWMGWINPNSDVTNYAQKFQGRVTLTRDTSISTAYIDLSRLRSDDTAIYYCARMGDGAVFDYWGQGTLVTVSS

SEQ ID NO: 1379 - DNA, 24 bp, Artificial Sequence
  Description of Artificial Sequence: Synthetic oligonucleotide
ggatacaccttcaccggctactat

SEQ ID NO: 1380 - protein, 8 aa, Artificial Sequence
  Description of Artificial Sequence: Synthetic peptide
GYTFTGYY

SEQ ID NO: 1381 - DNA, 24 bp, Artificial Sequence
  Description of Artificial Sequence: Synthetic oligonucleotide
atcaaccctaacagtgatgtcaca

SEQ ID NO: 1382 - protein, 8 aa, Artificial Sequence
  Description of Artificial Sequence: Synthetic peptide
INPNSDVT

SEQ ID NO: 1383 - DNA, 33 bp, Artificial Sequence; identical to SEQ ID NO: 1335
  Description of Artificial Sequence: Synthetic oligonucleotide

SEQ ID NO: 1384 - protein, 11 aa, Artificial Sequence
  Description of Artificial Sequence: Synthetic peptide
ARMGDGAVFDY

SEQ ID NO: 1385 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccattagtagtctgcaacctgaggattttgcatcttactactgtcaacagagttacaataccccgctcactttcggcggagggaccaaggtggagatcaaacga

SEQ ID NO: 1386 - protein, 108 aa, Artificial Sequence
  Description of Artificial Sequence: Synthetic polypeptide
DIQMTQSPSSLSASVGDRVTITCRASQRISSYLNWYQQKPGKAPKVLISVASSLQSGVPSRFSGSGSGTDFTLTISSLQPEDFASYYCQQSYNTPLTFGGGTKVEIKR

SEQ ID NO: 1387 - DNA, 18 bp, Artificial Sequence
  Description of Artificial Sequence: Synthetic oligonucleotide
cagcgcattagcagctat

SEQ ID NO: 1388 - protein, 6 aa, Artificial Sequence
  Description of Artificial Sequence: Synthetic peptide
QRISSY

SEQ ID NO: 1389 - DNA, 9 bp, Artificial Sequence
  Description of Artificial Sequence: Synthetic oligonucleotide
gttgcatcc

SEQ ID NO: 1390 - protein, 3 aa, Artificial Sequence
  Description of Artificial Sequence: Synthetic peptide
VAS

SEQ ID NO: 1391 - DNA, 27 bp, Artificial Sequence
  Description of Artificial Sequence: Synthetic oligonucleotide
caacagagttacaataccccgctcact

SEQ ID NO: 1392 - protein, 9 aa, Artificial Sequence
  Description of Artificial Sequence: Synthetic peptide
QQSYNTPLT

SEQ ID NO: 1393 - DNA, 381 bp, Artificial Sequence
  Description of Artificial Sequence: Synthetic polynucleotide
caggtgcagctggtgcagtctgggggaggcttggtcaagcctggggggtccctgagactctcctgtgcagcctctggattcaccttcagtagctatgacatgagctgggtccgccaggctccagggaaggggctggagtgggtttcatacattagtagtagtggtaataccatacattacgcagactctgtgaagggccgattcaccatctccagagacaattccaagaactcactttatctgcaaatgaacagcctgagagccgaggacacggccgtgtattactgtgcgaaagccggtcccgctacggtgacacggaggtactactactactacggtttggacgtctggggccaagggaccacggtcaccgtctcctca

SEQ ID NO: 1394 - protein, 127 aa, Artificial Sequence
  Description of Artificial Sequence: Synthetic polypeptide
QVQLVQSGGGLVKPGGSLRLSCAASGFTFSSYDMSWVRQAPGKGLEWVSYISSSGNTIHYADSVKGRFTISRDNSKNSLYLQMNSLRAEDTAVYYCAKAGPATVTRRYYYYYGLDVWGQGTTVTVSS

SEQ ID NO: 1395 - DNA, 24 bp, Artificial Sequence
  Description of Artificial Sequence: Synthetic oligonucleotide
ggattcaccttcagtagctatgac

SEQ ID NO: 1396 - protein, 8 aa, Artificial Sequence
  Description of Artificial Sequence: Synthetic peptide
GFTFSSYD

SEQ ID NO: 1397 - DNA, 24 bp, Artificial Sequence
  Description of Artificial Sequence: Synthetic oligonucleotide
attagtagtagtggtaataccata

SEQ ID NO: 1398 - protein, 8 aa, Artificial Sequence
  Description of Artificial Sequence: Synthetic peptide
ISSSGNTI

SEQ ID NO: 1399 - DNA, 60 bp, Artificial Sequence
  Description of Artificial Sequence: Synthetic oligonucleotide
gcgaaagccggtcccgctacggtgacacggaggtactactactactacggtttggacgtc

SEQ ID NO: 1400 - protein, 20 aa, Artificial Sequence
  Description of Artificial Sequence: Synthetic peptide
AKAGPATVTRRYYYYYGLDV

SEQ ID NO: 1401 - DNA, 324 bp, Artificial Sequence
  Description of Artificial Sequence: Synthetic polynucleotide
gacatcgtgatgacccagtctccatcctccctgtctgcatctgtacgagacagagtcaccatcacttgccgggcaagtcagagaattagcagctatttaaattggtttcagcagaaaccagggaaagcccctaaggtcctgatctatactgcatccagtttgcaaaatggggtcccatcaaggttcagtggcagtggatctgggacagatttcactctcaccatcagcagtctgcaacctgaagactttgcaacttactactgtcagcagagttacaggaccccgctcactttcggcggagggaccaaggtggagatcaaacga

SEQ ID NO: 1402 - protein, 108 aa, Artificial Sequence
  Description of Artificial Sequence: Synthetic polypeptide
DIVMTQSPSSLSASVRDRVTITCRASQRISSYLNWFQQKPGKAPKVLIYTASSLQNGVPSRFSGSGSGTDFTLTISSLQPEDFATYYCQQSYRTPLTFGGGTKVEIKR

SEQ ID NO: 1403 - DNA, 18 bp, Artificial Sequence
  Description of Artificial Sequence: Synthetic oligonucleotide
cagagaattagcagctat

SEQ ID NO: 1404 - protein, 6 aa, Artificial Sequence
  Description of Artificial Sequence: Synthetic peptide
QRISSY

SEQ ID NO: 1405 - DNA, 9 bp, Artificial Sequence
  Description of Artificial Sequence: Synthetic oligonucleotide
actgcatcc

SEQ ID NO: 1406 - protein, 3 aa, Artificial Sequence
  Description of Artificial Sequence: Synthetic peptide
TAS

SEQ ID NO: 1407 - DNA, 27 bp, Artificial Sequence
  Description of Artificial Sequence: Synthetic oligonucleotide
cagcagagttacaggaccccgctcact

SEQ ID NO: 1408 - protein, 9 aa, Artificial Sequence
  Description of Artificial Sequence: Synthetic peptide
QQSYRTPLT

SEQ ID NO: 1409 - DNA, 354 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacacattcatcggctactatatgcactgggtgcgacaggcccctggacaagggcttgagtggatgggatggatcaaccctaaaagtggtggcacaaactatgcacagaagtttcagggcagggtcaccatgaccggggacacgtccatcagcacagcctacatggagctgagcaggctgagatctgacgacacggccgtgttttactgtgcgagaatgggggacggtgcaatgtttgactactggggccagggaaccctggtcaccgtctcctca

SEQ ID NO: 1410 - protein, 118 aa, Artificial Sequence
  Description of Artificial Sequence: Synthetic polypeptide
QVQLVQSGAEVKKPGASVKVSCKASGYTFIGYYMHWVRQAPGQGLEWMGWINPKSGGTNYAQKFQGRVTMTGDTSISTAYMELSRLRSDDTAVFYCARMGDGAMFDYWGQGTLVTVSS

SEQ ID NO: 1411 - DNA, 24 bp, Artificial Sequence
  Description of Artificial Sequence: Synthetic oligonucleotide
ggatacacattcatcggctactat

SEQ ID NO: 1412 - protein, 8 aa, Artificial Sequence
  Description of Artificial Sequence: Synthetic peptide
GYTFIGYY

SEQ ID NO: 1413 - DNA, 24 bp, Artificial Sequence
  Description of Artificial Sequence: Synthetic oligonucleotide
atcaaccctaaaagtggtggcaca

SEQ ID NO: 1414 - protein, 8 aa, Artificial Sequence
  Description of Artificial Sequence: Synthetic peptide
INPKSGGT

SEQ ID NO: 1415 - DNA, 33 bp, Artificial Sequence
  Description of Artificial Sequence: Synthetic oligonucleotide
gcgagaatgggggacggtgcaatgtttgactac

SEQ ID NO: 1416 - protein, 11 aa, Artificial Sequence
  Description of Artificial Sequence: Synthetic peptide
ARMGDGAMFDY

SEQ ID NO: 1417 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagaattagcagctatttaaattggtatcagcagaaagcagggaaagcccctaaggtcctgatctatactgcatccagtttgcaaagtggggtcccatcacgattcagtggcagtggatctgggacagatttcactctcaccatcagcagtctgcaacctgaagattttgcaacttactactgtcaacagagttacagtaccccgctcactttcggcggagggaccaaggtggagatcaaa

SEQ ID NO: 1418 - protein, 107 aa, Artificial Sequence
  Description of Artificial Sequence: Synthetic polypeptide
DIQMTQSPSSLSASVGDRVTITCRASQRISSYLNWYQQKAGKAPKVLIYTASSLQSGVPSRFSGSGSGTDFTLTISSLQPEDFATYYCQQSYSTPLTFGGGTKVEIK

SEQ ID NO: 1419 - DNA, 18 bp, Artificial Sequence
  Description of Artificial Sequence: Synthetic oligonucleotide
cagagaattagcagctat

SEQ ID NO: 1420 - protein, 6 aa, Artificial Sequence
  Description of Artificial Sequence: Synthetic peptide
QRISSY

SEQ ID NO: 1421 - DNA, 9 bp, Artificial Sequence
  Description of Artificial Sequence: Synthetic oligonucleotide
actgcatcc

SEQ ID NO: 1422 - protein, 3 aa, Artificial Sequence
  Description of Artificial Sequence: Synthetic peptide
TAS

SEQ ID NO: 1423 - DNA, 27 bp, Artificial Sequence
  Description of Artificial Sequence: Synthetic oligonucleotide
caacagagttacagtaccccgctcact

SEQ ID NO: 1424 - protein, 9 aa, Artificial Sequence
  Description of Artificial Sequence: Synthetic peptide
QQSYSTPLT

SEQ ID NO: 1425 - DNA, 375 bp, Artificial Sequence
  Description of Artificial Sequence: Synthetic polynucleotide
caggtgcagctggtacagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatgatagcagctcgtcctggtactactactactacggtatggacgtctggggccgagggaccacggtcaccgtctcctca

SEQ ID NO: 1426 - protein, 125 aa, Artificial Sequence
  Description of Artificial Sequence: Synthetic polypeptide
QVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDDSSSSWYYYYYGMDVWGRGTTVTVSS

SEQ ID NO: 1427 - DNA, 24 bp, Artificial Sequence
  Description of Artificial Sequence: Synthetic oligonucleotide
ggattcacctttgatgattatgcc

SEQ ID NO: 1428 - protein, 8 aa, Artificial Sequence
  Description of Artificial Sequence: Synthetic peptide
GFTFDDYA

SEQ ID NO: 1429 - DNA, 24 bp, Artificial Sequence
  Description of Artificial Sequence: Synthetic oligonucleotide
attagtggggatggtggtagcaca

SEQ ID NO: 1430 - protein, 8 aa, Artificial Sequence
  Description of Artificial Sequence: Synthetic peptide
ISGDGGST

SEQ ID NO: 1431 - DNA, 54 bp, Artificial Sequence
  Description of Artificial Sequence: Synthetic oligonucleotide
gcaaaagatgatagcagctcgtcctggtactactactactacggtatggacgtc

SEQ ID NO: 1432 - protein, 18 aa, Artificial Sequence
  Description of Artificial Sequence: Synthetic peptide
AKDDSSSSWYYYYYGMDV

SEQ ID NO: 1433 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccatcagcagtctgcaacctgaggattttgcatcttactactgtcaacagagttacaataccccgctcactttcggcggagggaccaaggtggagatcaaacga

SEQ ID NO: 1434 - protein, 108 aa, Artificial Sequence; identical to SEQ ID NO: 1386
  Description of Artificial Sequence: Synthetic polypeptide

SEQ ID NO: 1435 - DNA, 18 bp, Artificial Sequence
  Description of Artificial Sequence: Synthetic oligonucleotide
cagcgcattagcagctat

SEQ ID NO: 1436 - protein, 6 aa, Artificial Sequence
  Description of Artificial Sequence: Synthetic peptide
QRISSY

SEQ ID NO: 1437 - DNA, 9 bp, Artificial Sequence
  Description of Artificial Sequence: Synthetic oligonucleotide
gttgcatcc

SEQ ID NO: 1438 - protein, 3 aa, Artificial Sequence
  Description of Artificial Sequence: Synthetic peptide
VAS

SEQ ID NO: 1439 - DNA, 27 bp, Artificial Sequence
  Description of Artificial Sequence: Synthetic oligonucleotide
caacagagttacaataccccgctcact

SEQ ID NO: 1440 - protein, 9 aa, Artificial Sequence
  Description of Artificial Sequence: Synthetic peptide
QQSYNTPLT

SEQ ID NO: 1441 - DNA, 372 bp, Artificial Sequence
  Description of Artificial Sequence: Synthetic polynucleotide
gaggtgcagctggtggagtctgggggaggcttggtacagcctggcaggtccctgagactctcctgtgcagcctctggattcacctttggtgattataccatgcactgggtccggcaagctccagggaagggcctggagtgggtctccgatattagttggaatagtggtagcaaagactatgcggactctgtgaagggccgattcaccatctccagagacaacgccaagaactccctctatcttcaaatgaacagtctgagaactgaggatacggccttttattactgtgcaaaagatagtaggggctacggtctctactaccacctcggtttggacgtctggggccaagggaccacggtcaccgtctcctca

SEQ ID NO: 1442 - protein, 124 aa, Artificial Sequence
  Description of Artificial Sequence: Synthetic polypeptide
EVQLVESGGGLVQPGRSLRLSCAASGFTFGDYTMHWVRQAPGKGLEWVSDISWNSGSKDYADSVKGRFTISRDNAKNSLYLQMNSLRTEDTAFYYCAKDSRGYGLYYHLGLDVWGQGTTVTVSS

SEQ ID NO: 1443 - DNA, 24 bp, Artificial Sequence
  Description of Artificial Sequence: Synthetic oligonucleotide
ggattcacctttggtgattatacc

SEQ ID NO: 1444 - protein, 8 aa, Artificial Sequence
  Description of Artificial Sequence: Synthetic peptide
GFTFGDYT

SEQ ID NO: 1445 - DNA, 24 bp, Artificial Sequence
  Description of Artificial Sequence: Synthetic oligonucleotide
attagttggaatagtggtagcaaa

SEQ ID NO: 1446 - protein, 8 aa, Artificial Sequence
  Description of Artificial Sequence: Synthetic peptide
ISWNSGSK

SEQ ID NO: 1447 - DNA, 51 bp, Artificial Sequence
  Description of Artificial Sequence: Synthetic oligonucleotide
gcaaaagatagtaggggctacggtctctactaccacctcggtttggacgtc

SEQ ID NO: 1448 - protein, 17 aa, Artificial Sequence
  Description of Artificial Sequence: Synthetic peptide
AKDSRGYGLYYHLGLDV

SEQ ID NO: 1449 - DNA, 372 bp, Artificial Sequence
  Description of Artificial Sequence: Synthetic polynucleotide
gaggtgcagctggtggagtctgggggaggcttggtgcagcctggcaggtccctgagactctcctgtgcagcctctggattcacctttgctgattataccatgcactgggtccggcaagctccagggaagggcctggagtgggtctcagatattagttggaatagtggtagtatagcctatgcggactctgtgaagggccgattcaccatctccagagacaacgccaagaactccctctatcttcaaatgaacagtctgagaactgaggacacggccttttattactgtgcaaaagatagtaggggctacggtcactataagtacctcggtttggacgtctggggccaagggaccacggtcaccgtctcctca

SEQ ID NO: 1450 - protein, 124 aa, Artificial Sequence
  Description of Artificial Sequence: Synthetic polypeptide
EVQLVESGGGLVQPGRSLRLSCAASGFTFADYTMHWVRQAPGKGLEWVSDISWNSGSIAYADSVKGRFTISRDNAKNSLYLQMNSLRTEDTAFYYCAKDSRGYGHYKYLGLDVWGQGTTVTVSS

SEQ ID NO: 1451 - DNA, 24 bp, Artificial Sequence
  Description of Artificial Sequence: Synthetic oligonucleotide
ggattcacctttgctgattatacc

SEQ ID NO: 1452 - protein, 8 aa, Artificial Sequence
  Description of Artificial Sequence: Synthetic peptide
GFTFADYT

SEQ ID NO: 1453 - DNA, 24 bp, Artificial Sequence
  Description of Artificial Sequence: Synthetic oligonucleotide
attagttggaatagtggtagtata

SEQ ID NO: 1454 - protein, 8 aa, Artificial Sequence
  Description of Artificial Sequence: Synthetic peptide
ISWNSGSI

SEQ ID NO: 1455 - DNA, 51 bp, Artificial Sequence
  Description of Artificial Sequence: Synthetic oligonucleotide
gcaaaagatagtaggggctacggtcactataagtacctcggtttggacgtc

SEQ ID NO: 1456 - protein, 17 aa, Artificial Sequence
  Description of Artificial Sequence: Synthetic peptide
AKDSRGYGHYKYLGLDV

SEQ ID NO: 1457 - DNA, 372 bp, Artificial Sequence
  Description of Artificial Sequence: Synthetic polynucleotide
gaggtgcagctggtggagtctgggggaggcatggtacagcctggcaggtccctgagactctcctgtgcagcctctggattccccttcaatgattacaccatgcactgggtccggcaagtcccagggaggggcctggagtgggtctcagatattagttggaatagcggcagtaaaggctatgcggactctgtgaagggtcgattcatcatctccagagacaacgccaagaactccctgtacctgcaaatgaacagtctgagagttgaagacacggccttgtattactgtgtaaaagatggaagtggctacgggaggttccattattacgctatggacgtctggggccaagggaccacggtcaccgtctcctca

SEQ ID NO: 1458 - protein, 124 aa, Artificial Sequence
  Description of Artificial Sequence: Synthetic polypeptide
EVQLVESGGGMVQPGRSLRLSCAASGFPFNDYTMHWVRQVPGRGLEWVSDISWNSGSKGYADSVKGRFIISRDNAKNSLYLQMNSLRVEDTALYYCVKDGSGYGRFHYYAMDVWGQGTTVTVSS

SEQ ID NO: 1459 - DNA, 24 bp, Artificial Sequence
  Description of Artificial Sequence: Synthetic oligonucleotide
ggattccccttcaatgattacacc

SEQ ID NO: 1460 - protein, 8 aa, Artificial Sequence
  Description of Artificial Sequence: Synthetic peptide
GFPFNDYT

SEQ ID NO: 1461 - DNA, 24 bp, Artificial Sequence
  Description of Artificial Sequence: Synthetic oligonucleotide
attagttggaatagcggcagtaaa

SEQ ID NO: 1462 - protein, 8 aa, Artificial Sequence
  Description of Artificial Sequence: Synthetic peptide
ISWNSGSK

SEQ ID NO: 1463 - DNA, 51 bp, Artificial Sequence
  Description of Artificial Sequence: Synthetic oligonucleotide
gtaaaagatggaagtggctacgggaggttccattattacgctatggacgtc

SEQ ID NO: 1464 - protein, 17 aa, Artificial Sequence
  Description of Artificial Sequence: Synthetic peptide
VKDGSGYGRFHYYAMDV

SEQ ID NO: 1465 - DNA, 372 bp, Artificial Sequence
  Description of Artificial Sequence: Synthetic polynucleotide
gaggtgcagctggtggagtctggtggaggcttggtacagcctggcaggtccctgagactctcctgtgcagcctctggattcacctttgctgattataccatgcactgggtccgccaagttccagggaagggcctggagtgggtctcagatattagttggaatagtggtagcaaagactatgcggactctgtgaagggccgcttcaccatctccagagacaacgccaagaatttcctgtatctgcaaatgaacagtctgagagctgaagacacggccttgtattactgtgtaaaatatggaagtggctacgggaaattctacttctacgctatggacgtctggggccaagggaccacggtcaccgtctcctca

SEQ ID NO: 1466 - protein, 124 aa, Artificial Sequence
  Description of Artificial Sequence: Synthetic polypeptide
EVQLVESGGGLVQPGRSLRLSCAASGFTFADYTMHWVRQVPGKGLEWVSDISWNSGSKDYADSVKGRFTISRDNAKNFLYLQMNSLRAEDTALYYCVKYGSGYGKFYFYAMDVWGQGTTVTVSS

SEQ ID NO: 1467 - DNA, 24 bp, Artificial Sequence
  Description of Artificial Sequence: Synthetic oligonucleotide
ggattcacctttgctgattatacc

SEQ ID NO: 1468 - protein, 8 aa, Artificial Sequence
  Description of Artificial Sequence: Synthetic peptide
GFTFADYT

SEQ ID NO: 1469 - DNA, 24 bp, Artificial Sequence
  Description of Artificial Sequence: Synthetic oligonucleotide
attagttggaatagtggtagcaaa

SEQ ID NO: 1470 - protein, 8 aa, Artificial Sequence
  Description of Artificial Sequence: Synthetic peptide
ISWNSGSK

SEQ ID NO: 1471 - DNA, 51 bp, Artificial Sequence
  Description of Artificial Sequence: Synthetic oligonucleotide
gtaaaatatggaagtggctacgggaaattctacttctacgctatggacgtc

SEQ ID NO: 1472 - protein, 17 aa, Artificial Sequence
  Description of Artificial Sequence: Synthetic peptide
VKYGSGYGKFYFYAMDV

SEQ ID NO: 1473 - DNA, 372 bp, Artificial Sequence
  Description of Artificial Sequence: Synthetic polynucleotide
gaggtgcagctggtgcagtctgggggaggcttggtacagcctggcaggtccctgagactctcctgtgcagcctctggattcacctttgctgattataccatgcactgggtccggcaaactccagggaagggcctggagtgggtctcaggtattagttggaatagtggtagcaaagactatgcggactctgtgaagggccgattcaccatctccagagacaacgccaagaactccctgtatctgcaaatgaacagtctgagaactgaggacacggccttgtattactgtgcaaaatatggaagtggctacgggagatatttcttctacgctatggacgtctggggccaagggaccacggtcaccgtctcctca

SEQ ID NO: 1474 - protein, 124 aa, Artificial Sequence
  Description of Artificial Sequence: Synthetic polypeptide
EVQLVQSGGGLVQPGRSLRLSCAASGFTFADYTMHWVRQTPGKGLEWVSGISWNSGSKDYADSVKGRFTISRDNAKNSLYLQMNSLRTEDTALYYCAKYGSGYGRYFFYAMDVWGQGTTVTVSS

SEQ ID NO: 1475 - DNA, 24 bp, Artificial Sequence
  Description of Artificial Sequence: Synthetic oligonucleotide
ggattcacctttgctgattatacc

SEQ ID NO: 1476 - protein, 8 aa, Artificial Sequence
  Description of Artificial Sequence: Synthetic peptide
GFTFADYT

SEQ ID NO: 1477 - DNA, 24 bp, Artificial Sequence
  Description of Artificial Sequence: Synthetic oligonucleotide
attagttggaatagtggtagcaaa

SEQ ID NO: 1478 - protein, 8 aa, Artificial Sequence
  Description of Artificial Sequence: Synthetic peptide
ISWNSGSK

SEQ ID NO: 1479 - DNA, 51 bp, Artificial Sequence
  Description of Artificial Sequence: Synthetic oligonucleotide
gcaaaatatggaagtggctacgggagatatttcttctacgctatggacgtc

SEQ ID NO: 1480 - protein, 17 aa, Artificial Sequence
  Description of Artificial Sequence: Synthetic peptide
AKYGSGYGRYFFYAMDV

SEQ ID NO: 1481 - DNA, 372 bp, Artificial Sequence
  Description of Artificial Sequence: Synthetic polynucleotide
gaggtgcagctggtggagtcaaggggagccttggtacagcctggcaggtccctgagactctcctgtgcagcctctggattcgcctttaatgattataccatgcactgggtccggcaagctccagggaagggcctggagtgggtctcagatattagttggaatagtaatagtaaagactatgcggactctgtgaagggccgattcaccatctccagagacaatgccaagaactccctctatctacaaatgaacagtctgagagctgaggacacggccttgtattactgtgtaaaagatggaagtggctacgggaaattttccctctacgctttggacgtctggggccaagggaccacggtcaccgtctcctca

SEQ ID NO: 1482 - protein, 124 aa, Artificial Sequence
  Description of Artificial Sequence: Synthetic polypeptide
EVQLVESRGALVQPGRSLRLSCAASGFAFNDYTMHWVRQAPGKGLEWVSDISWNSNSKDYADSVKGRFTISRDNAKNSLYLQMNSLRAEDTALYYCVKDGSGYGKFSLYALDVWGQGTTVTVSS

SEQ ID NO: 1483 - DNA, 24 bp, Artificial Sequence
  Description of Artificial Sequence: Synthetic oligonucleotide
ggattcgcctttaatgattatacc

SEQ ID NO: 1484 - protein, 8 aa, Artificial Sequence
  Description of Artificial Sequence: Synthetic peptide
GFAFNDYT

SEQ ID NO: 1485 - DNA, 24 bp, Artificial Sequence
  Description of Artificial Sequence: Synthetic oligonucleotide
attagttggaatagtaatagtaaa

SEQ ID NO: 1486 - protein, 8 aa, Artificial Sequence
  Description of Artificial Sequence: Synthetic peptide
ISWNSNSK

SEQ ID NO: 1487 - DNA, 51 bp, Artificial Sequence
  Description of Artificial Sequence: Synthetic oligonucleotide
gtaaaagatggaagtggctacgggaaattttccctctacgctttggacgtc

SEQ ID NO: 1488 - protein, 17 aa, Artificial Sequence
  Description of Artificial Sequence: Synthetic peptide
VKDGSGYGKFSLYALDV

SEQ ID NO: 1489 - DNA, 372 bp, Artificial Sequence
  Description of Artificial Sequence: Synthetic polynucleotide
caggtgcagctggtggagtctgggggaggcttggttcaccctggcaggtccctgagactctcctgtgcagcctctggattcaaatttgatgattataccatgcactgggtccggcaagctccagggaagggcctagagtgggtctcagatattagttggaatagtggtagtaaaggctatgcggactctgtgaagggccgattcaccatctccagagacaacgccaaggattccctatatctgcagatggacagtctgagagctgcagacacggccttctattactgtgcaaaagataaaagtggctacggccacttctactactacgctatggacgtctggggccaagggaccacggtcaccgtctcctca

SEQ ID NO: 1490 - protein, 124 aa, Artificial Sequence
  Description of Artificial Sequence: Synthetic polypeptide
QVQLVESGGGLVHPGRSLRLSCAASGFKFDDYTMHWVRQAPGKGLEWVSDISWNSGSKGYADSVKGRFTISRDNAKDSLYLQMDSLRAADTAFYYCAKDKSGYGHFYYYAMDVWGQGTTVTVSS

SEQ ID NO: 1491 - DNA, 24 bp, Artificial Sequence
  Description of Artificial Sequence: Synthetic oligonucleotide
ggattcaaatttgatgattatacc

SEQ ID NO: 1492 - protein, 8 aa, Artificial Sequence
  Description of Artificial Sequence: Synthetic peptide
GFKFDDYT

SEQ ID NO: 1493 - DNA, 24 bp, Artificial Sequence
  Description of Artificial Sequence: Synthetic oligonucleotide
attagttggaatagtggtagtaaa

SEQ ID NO: 1494 - protein, 8 aa, Artificial Sequence
  Description of Artificial Sequence: Synthetic peptide
ISWNSGSK

SEQ ID NO: 1495 - DNA, 51 bp, Artificial Sequence
  Description of Artificial Sequence: Synthetic oligonucleotide
gcaaaagataaaagtggctacggccacttctactactacgctatggacgtc

SEQ ID NO: 1496 - protein, 17 aa, Artificial Sequence
  Description of Artificial Sequence: Synthetic peptide
AKDKSGYGHFYYYAMDV

SEQ ID NO: 1497 - DNA, 372 bp, Artificial Sequence
  Description of Artificial Sequence: Synthetic polynucleotide
gaggtgcagctggtggagtctgggggaggcttggtacaccctggcaggtccctaagactctcctgtacagcctctggattcaagtttgctgattataccatgcactgggtccggcaagctccagggaagggcctggagtgggtctcagatattagttggaatagtggtagtaaaggctatgcggactctgtaaagggccgattcaccatctccagagacaatgacaagaactccctgtatctgcaaatgaacagtctgagaggtgaggacacggccttgtattactgtgcaaaagatggaagtggctacgggaggttccacttctacgctatcgacgtctggggccaagggaccacggtcaccgtctcctca

SEQ ID NO: 1498 - protein, 124 aa, Artificial Sequence
  Description of Artificial Sequence: Synthetic polypeptide
EVQLVESGGGLVHPGRSLRLSCTASGFKFADYTMHWVRQAPGKGLEWVSDISWNSGSKGYADSVKGRFTISRDNDKNSLYLQMNSLRGEDTALYYCAKDGSGYGRFHFYAIDVWGQGTTVTVSS

SEQ ID NO: 1499 - DNA, 24 bp, Artificial Sequence
  Description of Artificial Sequence: Synthetic oligonucleotide
ggattcaagtttgctgattatacc

SEQ ID NO: 1500 - protein, 8 aa, Artificial Sequence
  Description of Artificial Sequence: Synthetic peptide
GFKFADYT

SEQ ID NO: 1501 - DNA, 24 bp, Artificial Sequence
  Description of Artificial Sequence: Synthetic oligonucleotide
attagttggaatagtggtagtaaa

SEQ ID NO: 1502 - protein, 8 aa, Artificial Sequence
  Description of Artificial Sequence: Synthetic peptide
ISWNSGSK

SEQ ID NO: 1503 - DNA, 51 bp, Artificial Sequence
  Description of Artificial Sequence: Synthetic oligonucleotide
gcaaaagatggaagtggctacgggaggttccacttctacgctatcgacgtc

SEQ ID NO: 1504 - protein, 17 aa, Artificial Sequence
  Description of Artificial Sequence: Synthetic peptide
AKDGSGYGRFHFYAIDV

SEQ ID NO: 1505 - DNA, 372 bp, Artificial Sequence
  Description of Artificial Sequence: Synthetic polynucleotide
gaggtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1506 - protein, 124 aa, Artificial Sequence
  Description of Artificial Sequence: Synthetic polypeptide
EVQLVESGGGLVQPGRSLRLSCVASGFTFDDYSMHWVRQAPGKGLEWVSGISWNSGSKDYADSVKGRFTISRDNAKNSLYLQMNSLRAEDTALYYCAKYGSGYGKFYHYGLDVWGQGTTVTVSS

SEQ ID NO: 1507 - DNA, 24 bp, Artificial Sequence
  Description of Artificial Sequence: Synthetic oligonucleotide
ggattcacctttgatgattattcc

SEQ ID NO: 1508 - protein, 8 aa, Artificial Sequence
  Description of Artificial Sequence: Synthetic peptide
GFTFDDYS

SEQ ID NO: 1509 - DNA, 24 bp, Artificial Sequence
  Description of Artificial Sequence: Synthetic oligonucleotide
attagttggaatagtggtagcaaa

SEQ ID NO: 1510 - protein, 8 aa, Artificial Sequence
  Description of Artificial Sequence: Synthetic peptide
ISWNSGSK

SEQ ID NO: 1511 - DNA, 51 bp, Artificial Sequence
  Description of Artificial Sequence: Synthetic oligonucleotide
gcaaaatatggaagtggctacgggaagttctaccactacggtttggacgtc

SEQ ID NO: 1512 - protein, 17 aa, Artificial Sequence
  Description of Artificial Sequence: Synthetic peptide
AKYGSGYGKFYHYGLDV

SEQ ID NO: 1513 - DNA, 372 bp, Artificial Sequence
  Description of Artificial Sequence: Synthetic polynucleotide
caggtgcagttggtggagtctgggggaggcttggtacagcctggcaggtccctgagactctcctgtgcagcctctggattcacctttgctgattataccatgcactgggtccggcaggctccagggaagggcctggagtgggtctcagatattagttggaatagtggtagcatgggctatgcggactctgtgaagggccgattcaccatctccagagacaacgccaagaaatccctgtatctgcaaatgaacagtctgagaactgaggacacggccttgtattactgtgcaaaagatggaagtggctacgggaaatacttcttctacgctatggacgtctggggccaagggaccacggtcaccgtctcctca

SEQ ID NO: 1514 - protein, 124 aa, Artificial Sequence
  Description of Artificial Sequence: Synthetic polypeptide
QVQLVESGGGLVQPGRSLRLSCAASGFTFADYTMHWVRQAPGKGLEWVSDISWNSGSMGYADSVKGRFTISRDNAKKSLYLQMNSLRTEDTALYYCAKDGSGYGKYFFYAMDVWGQGTTVTVSS

SEQ ID NO: 1515 - DNA, 24 bp, Artificial Sequence
  Description of Artificial Sequence: Synthetic oligonucleotide
ggattcacctttgctgattatacc

SEQ ID NO: 1516 - protein, 8 aa, Artificial Sequence
  Description of Artificial Sequence: Synthetic peptide
GFTFADYT

SEQ ID NO: 1517 - DNA, 24 bp, Artificial Sequence
  Description of Artificial Sequence: Synthetic oligonucleotide
attagttggaatagtggtagcatg

SEQ ID NO: 1518 - protein, 8 aa, Artificial Sequence
  Description of Artificial Sequence: Synthetic peptide
ISWNSGSM

SEQ ID NO: 1519 - DNA, 51 bp, Artificial Sequence
  Description of Artificial Sequence: Synthetic oligonucleotide
gcaaaagatggaagtggctacgggaaatacttcttctacgctatggacgtc

SEQ ID NO: 1520 - protein, 17 aa, Artificial Sequence
  Description of Artificial Sequence: Synthetic peptide
AKDGSGYGKYFFYAMDV

SEQ ID NO: 1521 - DNA, 372 bp, Artificial Sequence
  Description of Artificial Sequence: Synthetic polynucleotide
gaggtgcagctggtgcagtctgggggaggcttggtacagcctggcaggtccctgagactctcctgtgcagcctctggattcaccttttctgattatactatgcattgggtccggcaaggtccagggaagggcctggagtgggtctcagatattagttggaatagtggtagtaaaggctatacggactctgtgaagggccgattcaccatttccagagacaacgccaagaagtccctgtatctacaaatgaacagtctgagagctgaggacacggccttgtactactgtgtaaaagatggaagtggctacgggaaataccacttctacgctatggacgtctggggccaagggaccctggtcaccgtctcctca

SEQ ID NO: 1522 - protein, 124 aa, Artificial Sequence
  Description of Artificial Sequence: Synthetic polypeptide
EVQLVQSGGGLVQPGRSLRLSCAASGFTFSDYTMHWVRQGPGKGLEWVSDISWNSGSKGYTDSVKGRFTISRDNAKKSLYLQMNSLRAEDTALYYCVKDGSGYGKYHFYAMDVWGQGTLVTVSS

SEQ ID NO: 1523 - DNA, 24 bp, Artificial Sequence
  Description of Artificial Sequence: Synthetic oligonucleotide
ggattcaccttttctgattatact

SEQ ID NO: 1524 - protein, 8 aa, Artificial Sequence
  Description of Artificial Sequence: Synthetic peptide
GFTFSDYT

SEQ ID NO: 1525 - DNA, 24 bp, Artificial Sequence
  Description of Artificial Sequence: Synthetic oligonucleotide
attagttggaatagtggtagtaaa

SEQ ID NO: 1526 - protein, 8 aa, Artificial Sequence
  Description of Artificial Sequence: Synthetic peptide
ISWNSGSK

SEQ ID NO: 1527 - DNA, 51 bp, Artificial Sequence
  Description of Artificial Sequence: Synthetic oligonucleotide
gtaaaagatggaagtggctacgggaaataccacttctacgctatggacgtc

SEQ ID NO: 1528 - protein, 17 aa, Artificial Sequence
  Description of Artificial Sequence: Synthetic peptide
VKDGSGYGKYHFYAMDV

SEQ ID NO: 1529 - DNA, 372 bp, Artificial Sequence
  Description of Artificial Sequence: Synthetic polynucleotide
gaggtgcagctggtggagtcggggggaggcttggttcaccctggcaggtccctgagactctcctgtgcagcctctggattcacctttgatgattataccatgcactgggtccggcaagctccagggaagggcctggaatgggtctcagatattagttggaatagtggtagcagaggctatgcggactctgtgaagggccgattcaccatctccagagataatgccgagaactccctgtacctgcaaatgaacagtctgagagctgaggacacggccttgtattactgtgcaaaagataaaagtggctacggccactactactactacgctatggacgtctggggccaagggaccacggtcaccgtctcctca

SEQ ID NO: 1530 - protein, 124 aa, Artificial Sequence
  Description of Artificial Sequence: Synthetic polypeptide
EVQLVESGGGLVHPGRSLRLSCAASGFTFDDYTMHWVRQAPGKGLEWVSDISWNSGSRGYADSVKGRFTISRDNAENSLYLQMNSLRAEDTALYYCAKDKSGYGHYYYYAMDVWGQGTTVTVSS

SEQ ID NO: 1531 - DNA, 24 bp, Artificial Sequence
  Description of Artificial Sequence: Synthetic oligonucleotide
ggattcacctttgatgattatacc

SEQ ID NO: 1532 - protein, 8 aa, Artificial Sequence
  Description of Artificial Sequence: Synthetic peptide
GFTFDDYT

SEQ ID NO: 1533 - DNA, 24 bp, Artificial Sequence
  Description of Artificial Sequence: Synthetic oligonucleotide
attagttggaatagtggtagcaga

SEQ ID NO: 1534 - protein, 8 aa, Artificial Sequence
  Description of Artificial Sequence: Synthetic peptide
ISWNSGSR

SEQ ID NO: 1535 - DNA, 51 bp, Artificial Sequence
  Description of Artificial Sequence: Synthetic oligonucleotide
gcaaaagataaaagtggctacggccactactactactacgctatggacgtc

SEQ ID NO: 1536 - protein, 17 aa, Artificial Sequence
  Description of Artificial Sequence: Synthetic peptide
AKDKSGYGHYYYYAMDV

SEQ ID NO: 1537 - DNA, 372 bp, Artificial Sequence
  Description of Artificial Sequence: Synthetic polynucleotide
gaggtgcagctggtggagtctgggggaggcttggtacagcctggcgggtccctgagactctcctgtgaagcctctggattcacctttgctgattataccttgcactgggtccggcaagctccagggaagggcctggaatgggtctcagatattagttggaatagtggcaccagaggctatgcggactctgtgaggggccgattcaccatctccagagacaacgccaagaagtccctgtatctgcaaatgaacagtctgagatctgaggacacggccttgtattactgtgtgaaagatggaagtggctacgggagatataatttctacgctatggacgtctggggccaagggaccacggtcaccgtctcctca

SEQ ID NO: 1538 - protein, 124 aa, Artificial Sequence
  Description of Artificial Sequence: Synthetic polypeptide
EVQLVESGGGLVQPGGSLRLSCEASGFTFADYTLHWVRQAPGKGLEWVSDISWNSGTRGYADSVRGRFTISRDNAKKSLYLQMNSLRSEDTALYYCVKDGSGYGRYNFYAMDVWGQGTTVTVSS

SEQ ID NO: 1539 - DNA, 24 bp, Artificial Sequence
  Description of Artificial Sequence: Synthetic oligonucleotide
ggattcacctttgctgattatacc

SEQ ID NO: 1540 - protein, 8 aa, Artificial Sequence
  Description of Artificial Sequence: Synthetic peptide
GFTFADYT

SEQ ID NO: 1541 - DNA, 24 bp, Artificial Sequence
  Description of Artificial Sequence: Synthetic oligonucleotide
attagttggaatagtggcaccaga

SEQ ID NO: 1542 - protein, 8 aa, Artificial Sequence
  Description of Artificial Sequence: Synthetic peptide
ISWNSGTR

SEQ ID NO: 1543 - DNA, 51 bp, Artificial Sequence
  Description of Artificial Sequence: Synthetic oligonucleotide
gtgaaagatggaagtggctacgggagatataatttctacgctatggacgtc

SEQ ID NO: 1544 - protein, 17 aa, Artificial Sequence
  Description of Artificial Sequence: Synthetic peptide
VKDGSGYGRYNFYAMDV

SEQ ID NO: 1545 - DNA, 369 bp, Artificial Sequence
  Description of Artificial Sequence: Synthetic polynucleotide
gaggtgcagctggtggagtctgggggaggcttggttcagcctggcaggtccctgagactctcctgtgcagcctctggatttacctttgctgactataccatgcactgggtccggcaaggtccagggaagggcctggagtgggtctcagatattggttggaatagtaatactataggctatgcggactctgtgaagggccgattcgccatctccagagacaacgccaagaactccctgtatcttcaaatgaacagtctgcgacctgaggacacggccttatattactgtgtaaaggataaaagtggctacgggaaattccaatacggtttggacgtctggggccaagggaccacggtcaccgtctcctca

SEQ ID NO: 1546 - protein, 123 aa, Artificial Sequence
  Description of Artificial Sequence: Synthetic polypeptide
EVQLVESGGGLVQPGRSLRLSCAASGFTFADYTMHWVRQGPGKGLEWVSDIGWNSNTIGYADSVKGRFAISRDNAKNSLYLQMNSLRPEDTALYYCVKDKSGYGKFQYGLDVWGQGTTVTVSS

SEQ ID NO: 1547 - DNA, 24 bp, Artificial Sequence
  Description of Artificial Sequence: Synthetic oligonucleotide
ggatttacctttgctgactatacc

SEQ ID NO: 1548 - protein, 8 aa, Artificial Sequence
  Description of Artificial Sequence: Synthetic peptide
GFTFADYT

SEQ ID NO: 1549 - DNA, 24 bp, Artificial Sequence
  Description of Artificial Sequence: Synthetic oligonucleotide
attggttggaatagtaatactata

SEQ ID NO: 1550 - protein, 8 aa, Artificial Sequence
  Description of Artificial Sequence: Synthetic peptide
IGWNSNTI

SEQ ID NO: 1551 - DNA, 48 bp, Artificial Sequence
  Description of Artificial Sequence: Synthetic oligonucleotide
gtaaaggataaaagtggctacgggaaattccaatacggtttggacgtc

SEQ ID NO: 1552 - protein, 16 aa, Artificial Sequence
  Description of Artificial Sequence: Synthetic peptide
VKDKSGYGKFQYGLDV

SEQ ID NO: 1553 - DNA, 369 bp, Artificial Sequence
  Description of Artificial Sequence: Synthetic polynucleotide
gaggtgcagctggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaacagtataggctatgcggactctgtgaagggccgattcaccatctccagagacaacgccaagaactccctgtatctccaaatgaacagtctgagacctgaggacacggccttgtatttctgtgtaaaggataaaagtggctacgggaaatttttcatcggtttggacgtctggggccaagggacaatggtcaccgtctcttca

SEQ ID NO: 1554 - protein, 123 aa, Artificial Sequence
  Description of Artificial Sequence: Synthetic polypeptide
EVQLVESGGGLVQPGRSLRLSCAASGFTFDDYTMHWVRQGPGKGLEWVSDIGWNSNSIGYADSVKGRFTISRDNAKNSLYLQMNSLRPEDTALYFCVKDKSGYGKFFIGLDVWGQGTMVTVSS

SEQ ID NO: 1555 - DNA, 24 bp, Artificial Sequence
  Description of Artificial Sequence: Synthetic oligonucleotide
ggatttacatttgacgattatacc

SEQ ID NO: 1556 - protein, 8 aa, Artificial Sequence
  Description of Artificial Sequence: Synthetic peptide
GFTFDDYT

SEQ ID NO: 1557 - DNA, 24 bp, Artificial Sequence
  Description of Artificial Sequence: Synthetic oligonucleotide
attggttggaatagtaacagtata

SEQ ID NO: 1558 - protein, 8 aa, Artificial Sequence
  Description of Artificial Sequence: Synthetic peptide
IGWNSNSI

SEQ ID NO: 1559 - DNA, 48 bp, Artificial Sequence
  Description of Artificial Sequence: Synthetic oligonucleotide
gtaaaggataaaagtggctacgggaaatttttcatcggtttggacgtc

SEQ ID NO: 1560 - protein, 16 aa, Artificial Sequence
  Description of Artificial Sequence: Synthetic peptide
VKDKSGYGKFFIGLDV

SEQ ID NO: 1561 - DNA, 369 bp, Artificial Sequence
  Description of Artificial Sequence: Synthetic polynucleotide
caggtgcagttggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaatactaaaggctatgcggactctgtgaagggccgattcaccatctccagagacaacgccaagaattccctgtatctccaaatgaacagtctgagacctgaggacacggccttgtatttctgtgtgaaggataaaagtggctacgggaaatttttcatcggtttggacgtctggggccaagggacaatggtcaccgtctcttca

SEQ ID NO: 1562 - protein, 123 aa, Artificial Sequence
  Description of Artificial Sequence: Synthetic polypeptide
QVQLVESGGGLVQPGRSLRLSCAASGFTFDDYTMHWVRQGPGKGLEWVSDIGWNSNTKGYADSVKGRFTISRDNAKNSLYLQMNSLRPEDTALYFCVKDKSGYGKFFIGLDVWGQGTMVTVSS

SEQ ID NO: 1563 - DNA, 24 bp, Artificial Sequence
  Description of Artificial Sequence: Synthetic oligonucleotide
ggatttacatttgacgattatacc

SEQ ID NO: 1564 - protein, 8 aa, Artificial Sequence
  Description of Artificial Sequence: Synthetic peptide
GFTFDDYT

SEQ ID NO: 1565 - DNA, 24 bp, Artificial Sequence
  Description of Artificial Sequence: Synthetic oligonucleotide
attggttggaatagtaatactaaa

SEQ ID NO: 1566 - protein, 8 aa, Artificial Sequence
  Description of Artificial Sequence: Synthetic peptide
IGWNSNTK

SEQ ID NO: 1567 - DNA, 48 bp, Artificial Sequence
  Description of Artificial Sequence: Synthetic oligonucleotide
gtgaaggataaaagtggctacgggaaatttttcatcggtttggacgtc

SEQ ID NO: 1568 - protein, 16 aa, Artificial Sequence
  Description of Artificial Sequence: Synthetic peptide
VKDKSGYGKFFIGLDV

SEQ ID NO: 1569 - DNA, 369 bp, Artificial Sequence
  Description of Artificial Sequence: Synthetic polynucleotide
gaggtgcagctggtggagtctgggggaggcttggtccagcctgggcggtccctgagactctcctgtgcagcctccggattcacctttgctgattataccatgcactgggtccggcaaggtccagggacgggcctggagtgggtctcagatattggttggagtggtggtagtttaggctatgcggactctgtgaagggccgattcaccatctccagagacaacgccaagaactccctgtatttggaaatgaacaatctgcgacctgaagacacggccttgtattattgtgtaaaggataaaagtggctacgggaaattccagtacggtttggacgtctggggccaagggaccacggtcaccgtctcctca

SEQ ID NO: 1570 - protein, 123 aa, Artificial Sequence
  Description of Artificial Sequence: Synthetic polypeptide
EVQLVESGGGLVQPGRSLRLSCAASGFTFADYTMHWVRQGPGTGLEWVSDIGWSGGSLGYADSVKGRFTISRDNAKNSLYLEMNNLRPEDTALYYCVKDKSGYGKFQYGLDVWGQGTTVTVSS

SEQ ID NO: 1571 - DNA, 24 bp, Artificial Sequence
  Description of Artificial Sequence: Synthetic oligonucleotide
ggattcacctttgctgattatacc

SEQ ID NO: 1572 - protein, 8 aa, Artificial Sequence
  Description of Artificial Sequence: Synthetic peptide
GFTFADYT

SEQ ID NO: 1573 - DNA, 24 bp, Artificial Sequence
  Description of Artificial Sequence: Synthetic oligonucleotide
attggttggagtggtggtagttta

SEQ ID NO: 1574 - protein, 8 aa, Artificial Sequence
  Description of Artificial Sequence: Synthetic peptide
IGWSGGSL

SEQ ID NO: 1575 - DNA, 48 bp, Artificial Sequence
  Description of Artificial Sequence: Synthetic oligonucleotide
gtaaaggataaaagtggctacgggaaattccagtacggtttggacgtc

SEQ ID NO: 1576 - protein, 16 aa, Artificial Sequence
  Description of Artificial Sequence: Synthetic peptide
VKDKSGYGKFQYGLDV

SEQ ID NO: 1577 - DNA, 369 bp, Artificial Sequence
  Description of Artificial Sequence: Synthetic polynucleotide
gaggtgcagctggtggagtctgggggaggcgtggtacagcctggcaggtccctgagactctcctgtgcagcctctgggtttaaatttgatggttataccatgcactgggtccggcaaggtccagggaagggcctggagtgggtctcagatattggttggaatagtaacactataggctatgcggactctgtgaagggccgattcaccatctccagagacaacgccaagaactccctgtatctccaaatgaacagtctgagaccagaggacacggccttgtatttctgtgtaaaggataaaagtggctacgggaaatttttcatcggtttggacgtctggggccaagggacaatggtcaccgtctcttca

SEQ ID NO: 1578 - protein, 123 aa, Artificial Sequence
  Description of Artificial Sequence: Synthetic polypeptide
EVQLVESGGGVVQPGRSLRLSCAASGFKFDGYTMHWVRQGPGKGLEWVSDIGWNSNTIGYADSVKGRFTISRDNAKNSLYLQMNSLRPEDTALYFCVKDKSGYGKFFIGLDVWGQGTMVTVSS

SEQ ID NO: 1579 - DNA, 24 bp, Artificial Sequence
  Description of Artificial Sequence: Synthetic oligonucleotide
gggtttaaatttgatggttatacc

SEQ ID NO: 1580 - protein, 8 aa, Artificial Sequence
  Description of Artificial Sequence: Synthetic peptide
GFKFDGYT

SEQ ID NO: 1581 - DNA, 24 bp, Artificial Sequence
  Description of Artificial Sequence: Synthetic oligonucleotide
attggttggaatagtaacactata

SEQ ID NO: 1582 - protein, 8 aa, Artificial Sequence
  Description of Artificial Sequence: Synthetic peptide
IGWNSNTI

SEQ ID NO: 1583 - DNA, 48 bp, Artificial Sequence; identical to SEQ ID NO: 1559
  Description of Artificial Sequence: Synthetic oligonucleotide

SEQ ID NO: 1584 - protein, 16 aa, Artificial Sequence
  Description of Artificial Sequence: Synthetic peptide
VKDKSGYGKFFIGLDV

SEQ ID NO: 1585 - DNA, 369 bp, Artificial Sequence
  Description of Artificial Sequence: Synthetic polynucleotide
caggtgcagctggtggagtctgggggaggcttggtacagcctggcaggtccctgagactctcctgtgcagcctctggattcacctttgatgattataccatgcactgggtccggcaaggtccagggaagggcctggagtgggtctcagatattggttggaatagtaatactataggctatgcggactctgtgaagggccgattcaccatctccagagacaacgccaggaactccctgtatctgcaaatgaacagtctgcgacctgaagacacggccttatattactgtgtaaaggataaaagtggctacgggaaattccaatacggtttggacgtctggggccaagggaccacggtcaccgtctcctca

SEQ ID NO: 1586 - protein, 123 aa, Artificial Sequence
  Description of Artificial Sequence: Synthetic polypeptide
QVQLVESGGGLVQPGRSLRLSCAASGFTFDDYTMHWVRQGPGKGLEWVSDIGWNSNTIGYADSVKGRFTISRDNARNSLYLQMNSLRPEDTALYYCVKDKSGYGKFQYGLDVWGQGTTVTVSS

SEQ ID NO: 1587 - DNA, 24 bp, Artificial Sequence
  Description of Artificial Sequence: Synthetic oligonucleotide
ggattcacctttgatgattatacc

SEQ ID NO: 1588 - protein, 8 aa, Artificial Sequence
  Description of Artificial Sequence: Synthetic peptide
GFTFDDYT

SEQ ID NO: 1589 - DNA, 24 bp, Artificial Sequence
  Description of Artificial Sequence: Synthetic oligonucleotide
attggttggaatagtaatactata

SEQ ID NO: 1590 - protein, 8 aa, Artificial Sequence
  Description of Artificial Sequence: Synthetic peptide
IGWNSNTI

SEQ ID NO: 1591 - DNA, 48 bp, Artificial Sequence; identical to SEQ ID NO: 1551
  Description of Artificial Sequence: Synthetic oligonucleotide

SEQ ID NO: 1592 - protein, 16 aa, Artificial Sequence
  Description of Artificial Sequence: Synthetic peptide
VKDKSGYGKFQYGLDV

SEQ ID NO: 1593 - DNA, 369 bp, Artificial Sequence
  Description of Artificial Sequence: Synthetic polynucleotide
caggtgcaactggtggagtctgggggaggcttggtacagcctggcaggtccctgagactctcctgtgcagcctctggattcaagtttgatgattataccatgcactgggtccggcaaggtccagggaagggcctggagtgggtctcagacattagttggagtggtggtagcatagactatacggactctgtgaagggccgattctccatctccagagacaacgccaagaactccctgtatctgcaaatgaacagtctgagagttgaagacacggccttgtattattgtgtaaaagataaaagtggctacgggaagtactcttacggtttggacgtctggggccaagggaccacggtcaccgtctcctca

SEQ ID NO: 1594 - protein, 123 aa, Artificial Sequence
  Description of Artificial Sequence: Synthetic polypeptide
QVQLVESGGGLVQPGRSLRLSCAASGFKFDDYTMHWVRQGPGKGLEWVSDISWSGGSIDYTDSVKGRFSISRDNAKNSLYLQMNSLRVEDTALYYCVKDKSGYGKYSYGLDVWGQGTTVTVSS

SEQ ID NO: 1595 - DNA, 24 bp, Artificial Sequence
  Description of Artificial Sequence: Synthetic oligonucleotide
ggattcaagtttgatgattatacc

SEQ ID NO: 1596 - protein, 8 aa, Artificial Sequence
  Description of Artificial Sequence: Synthetic peptide
GFKFDDYT

SEQ ID NO: 1597 - DNA, 24 bp, Artificial Sequence
  Description of Artificial Sequence: Synthetic oligonucleotide
attagttggagtggtggtagcata

SEQ ID NO: 1598 - protein, 8 aa, Artificial Sequence
  Description of Artificial Sequence: Synthetic peptide
ISWSGGSI

SEQ ID NO: 1599 - DNA, 48 bp, Artificial Sequence
  Description of Artificial Sequence: Synthetic oligonucleotide
gtaaaagataaaagtggctacgggaagtactcttacggtttggacgtc

SEQ ID NO: 1600 - protein, 16 aa, Artificial Sequence
  Description of Artificial Sequence: Synthetic peptide
VKDKSGYGKYSYGLDV

SEQ ID NO: 1601 - DNA, 357 bp, Artificial Sequence
  Description of Artificial Sequence: Synthetic polynucleotide
gaggtgcagctggtggagtctgggggaggcttggtaaagccgggggggtcccttagaatctcctgtgcagcctctggattctctttcattaacgcctggatgaactgggtccgccaggctccagggaaggggctggagtgggttggccgtattaaaagcataagtgatggtgggacaacagactacgctgcatccgtgaaaggcagattcaccatctcaagagaagattcaaaaaatatgctgtttctggaaatgaatagtctgaaaaccgaggacacagccgtgttttactgtaccacagaggtcgctagaactccgaactactggggccggggaaccctggtcaccgtctcctca

SEQ ID NO: 1602 - protein, 119 aa, Artificial Sequence
  Description of Artificial Sequence: Synthetic polypeptide
EVQLVESGGGLVKPGGSLRISCAASGFSFINAWMNWVRQAPGKGLEWVGRIKSISDGGTTDYAASVKGRFTISREDSKNMLFLEMNSLKTEDTAVFYCTTEVARTPNYWGRGTLVTVSS

SEQ ID NO: 1603 - DNA, 24 bp, Artificial Sequence
  Description of Artificial Sequence: Synthetic oligonucleotide
ggattctctttcattaacgcctgg

SEQ ID NO: 1604 - protein, 8 aa, Artificial Sequence
  Description of Artificial Sequence: Synthetic peptide
GFSFINAW

SEQ ID NO: 1605 - DNA, 30 bp, Artificial Sequence
  Description of Artificial Sequence: Synthetic oligonucleotide
attaaaagcataagtgatggtgggacaaca

SEQ ID NO: 1606 - protein, 10 aa, Artificial Sequence
  Description of Artificial Sequence: Synthetic peptide
IKSISDGGTT

SEQ ID NO: 1607 - DNA, 30 bp, Artificial Sequence
  Description of Artificial Sequence: Synthetic oligonucleotide
accacagaggtcgctagaactccgaactac

SEQ ID NO: 1608 - protein, 10 aa, Artificial Sequence
  Description of Artificial Sequence: Synthetic peptide
TTEVARTPNY

SEQ ID NO: 1609 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1610 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGLDVWGQGTTVTVSS

SEQ ID NO: 1611 - DNA, 24 bp, Artificial Sequence
  Description of Artificial Sequence: Synthetic oligonucleotide
gggtttacattcgacgattacagc

SEQ ID NO: 1612 - protein, 8 aa, Artificial Sequence
  Description of Artificial Sequence: Synthetic peptide
GFTFDDYS

SEQ ID NO: 1613 - DNA, 24 bp, Artificial Sequence
  Description of Artificial Sequence: Synthetic oligonucleotide
atatcatggaactcaggaagcaag

SEQ ID NO: 1614 - protein, 8 aa, Artificial Sequence
  Description of Artificial Sequence: Synthetic peptide
ISWNSGSK

SEQ ID NO: 1615 - DNA, 51 bp, Artificial Sequence
  Description of Artificial Sequence: Synthetic oligonucleotide
gcaaaatacggcagtggttatggcaagttttatcattatggactggacgtg

SEQ ID NO: 1616 - protein, 17 aa, Artificial Sequence
  Description of Artificial Sequence: Synthetic peptide
AKYGSGYGKFYHYGLDV

SEQ ID NO: 1617 - DNA, 372 bp, Artificial Sequence
  Description of Artificial Sequence: Synthetic polynucleotide
gaagtacaactggtcgaatctggaggaggtcttgttcaacctggtcgatcacttcgcctttcttgtgccgcttctggtttcactttcgacgattatagcatgcattgggtacgacaggctcccggaaaagggctggaatgggtgtcaggaattagttggaactcaggaagtattggatacgctgattcagtcaaaggacgcttcacaatctcaagggacaacgctaaaaactcactttatttgcaaatgaactctctccgcgctgaagataccgctctctattattgcgccaaagatgggtctggttacggttatttttactactatggaatggacgtttggggccaaggaacaactgtcacagtatcatcc

SEQ ID NO: 1618 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1619 - DNA, 24 bp, Artificial Sequence
  Description of Artificial Sequence: Synthetic oligonucleotide
ggtttcactttcgacgattatagc

SEQ ID NO: 1620 - protein, 8 aa, Artificial Sequence
  Description of Artificial Sequence: Synthetic peptide
GFTFDDYS

SEQ ID NO: 1621 - DNA, 24 bp, Artificial Sequence
  Description of Artificial Sequence: Synthetic oligonucleotide
attagttggaactcaggaagtatt

SEQ ID NO: 1622 - protein, 8 aa, Artificial Sequence
  Description of Artificial Sequence: Synthetic peptide
ISWNSGSI

SEQ ID NO: 1623 - DNA, 51 bp, Artificial Sequence
  Description of Artificial Sequence: Synthetic oligonucleotide
gccaaagatgggtctggttacggttatttttactactatggaatggacgtt

SEQ ID NO: 1624 - protein, 17 aa, Artificial Sequence
  Description of Artificial Sequence: Synthetic peptide
AKDGSGYGYFYYYGMDV

SEQ ID NO: 1625 - DNA, 372 bp, Artificial Sequence
  Description of Artificial Sequence: Synthetic polynucleotide
gaagtgcaactcgttgaaagcggaggaggactggtccagcccggcagatctctcagattgtcttgcgctgcatccggatttacatttgacgactattcaatgcactgggtacggcaagccccaggtaaaggactcgaatgggtaagcggcatatcttggaactcaggcagtattggctacgcagattcagtaaaaggaagattcactatttcaagggataatgctaagaacagtctctacttgcaaatgaatagcttgcgcgcagaagatacagcactttattattgtgcaaaagatggaagcggttatgggaaattttattattatggtatggatgtatggggtcaaggtacaacagttactgtgtcaagt

SEQ ID NO: 1626 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1627 - DNA, 24 bp, Artificial Sequence
  Description of Artificial Sequence: Synthetic oligonucleotide
ggatttacatttgacgactattca

SEQ ID NO: 1628 - protein, 8 aa, Artificial Sequence
  Description of Artificial Sequence: Synthetic peptide
GFTFDDYS

SEQ ID NO: 1629 - DNA, 24 bp, Artificial Sequence
  Description of Artificial Sequence: Synthetic oligonucleotide
atatcttggaactcaggcagtatt

SEQ ID NO: 1630 - protein, 8 aa, Artificial Sequence
  Description of Artificial Sequence: Synthetic peptide
ISWNSGSI

SEQ ID NO: 1631 - DNA, 51 bp, Artificial Sequence
  Description of Artificial Sequence: Synthetic oligonucleotide
gcaaaagatggaagcggttatgggaaattttattattatggtatggatgta

SEQ ID NO: 1632 - protein, 17 aa, Artificial Sequence
  Description of Artificial Sequence: Synthetic peptide
AKDGSGYGKFYYYGMDV

SEQ ID NO: 1633 - DNA, 324 bp, Artificial Sequence; identical to SEQ ID NO: 57
  Description of Artificial Sequence: Synthetic polynucleotide

SEQ ID NO: 1634 - protein, 108 aa, Artificial Sequence; identical to SEQ ID NO: 58
  Description of Artificial Sequence: Synthetic polypeptide

SEQ ID NO: 1635 - DNA, 18 bp, Artificial Sequence
  Description of Artificial Sequence: Synthetic oligonucleotide
cagagcattagcagctat

SEQ ID NO: 1636 - protein, 6 aa, Artificial Sequence
  Description of Artificial Sequence: Synthetic peptide
QSISSY

SEQ ID NO: 1637 - DNA, 9 bp, Artificial Sequence
  Description of Artificial Sequence: Synthetic oligonucleotide
gctgcatcc

SEQ ID NO: 1638 - protein, 3 aa, Artificial Sequence
  Description of Artificial Sequence: Synthetic peptide
AAS

SEQ ID NO: 1639 - DNA, 30 bp, Artificial Sequence; identical to SEQ ID NO: 15
  Description of Artificial Sequence: Synthetic oligonucleotide

SEQ ID NO: 1640 - protein, 10 aa, Artificial Sequence
  Description of Artificial Sequence: Synthetic peptide
QQSYSTPPIT

SEQ ID NO: 1641 - DNA, 369 bp, Artificial Sequence; identical to SEQ ID NO: 513
  Description of Artificial Sequence: Synthetic polynucleotide

SEQ ID NO: 1642 - protein, 123 aa, Artificial Sequence; identical to SEQ ID NO: 514
  Description of Artificial Sequence: Synthetic polypeptide

SEQ ID NO: 1643 - DNA, 24 bp, Artificial Sequence
  Description of Artificial Sequence: Synthetic oligonucleotide
ggattcacctttgatgattatacc

SEQ ID NO: 1644 - protein, 8 aa, Artificial Sequence
  Description of Artificial Sequence: Synthetic peptide
GFTFDDYT

SEQ ID NO: 1645 - DNA, 24 bp, Artificial Sequence
  Description of Artificial Sequence: Synthetic oligonucleotide
attagttggaatagtggtagtata

SEQ ID NO: 1646 - protein, 8 aa, Artificial Sequence
  Description of Artificial Sequence: Synthetic peptide
ISWNSGSI

SEQ ID NO: 1647 - DNA, 48 bp, Artificial Sequence; identical to SEQ ID NO: 519
  Description of Artificial Sequence: Synthetic oligonucleotide

SEQ ID NO: 1648 - protein, 16 aa, Artificial Sequence
  Description of Artificial Sequence: Synthetic peptide
AKDNSGYGHYYYGMDV

SEQ ID NO: 1649 - DNA, 320 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaa

SEQ ID NO: 1650 - protein, 108 aa, Artificial Sequence
  Description of Artificial Sequence: Synthetic polypeptide
AEIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 1651 - DNA, 18 bp, Artificial Sequence
  Description of Artificial Sequence: Synthetic oligonucleotide
cagagtgttagcagcaac

SEQ ID NO: 1652 - protein, 6 aa, Artificial Sequence
  Description of Artificial Sequence: Synthetic peptide
QSVSSN

SEQ ID NO: 1653 - DNA, 9 bp, Artificial Sequence
  Description of Artificial Sequence: Synthetic oligonucleotide
ggtgcatcc

SEQ ID NO: 1654 - protein, 3 aa, Artificial Sequence
  Description of Artificial Sequence: Synthetic peptide
GAS

SEQ ID NO: 1655 - DNA, 27 bp, Artificial Sequence
  Description of Artificial Sequence: Synthetic oligonucleotide
cagcactatattaactggcctctcact

SEQ ID NO: 1656 - protein, 9 aa, Artificial Sequence
  Description of Artificial Sequence: Synthetic peptide
QHYINWPLT

SEQ ID NO: 1657 - DNA, 369 bp, Artificial Sequence; identical to SEQ ID NO: 401
  Description of Artificial Sequence: Synthetic polynucleotide

SEQ ID NO: 1658 - protein, 123 aa, Artificial Sequence; identical to SEQ ID NO: 402
  Description of Artificial Sequence: Synthetic polypeptide

SEQ ID NO: 1659 - DNA, 24 bp, Artificial Sequence
  Description of Artificial Sequence: Synthetic oligonucleotide
ggattcacctttgatgattttacc

SEQ ID NO: 1660 - protein, 8 aa, Artificial Sequence
  Description of Artificial Sequence: Synthetic peptide
GFTFDDFT

SEQ ID NO: 1661 - DNA, 24 bp, Artificial Sequence
  Description of Artificial Sequence: Synthetic oligonucleotide
atcagttggaatagtggtagcata

SEQ ID NO: 1662 - protein, 8 aa, Artificial Sequence
  Description of Artificial Sequence: Synthetic peptide
ISWNSGSI

SEQ ID NO: 1663 - DNA, 48 bp, Artificial Sequence; identical to SEQ ID NO: 407
  Description of Artificial Sequence: Synthetic oligonucleotide

SEQ ID NO: 1664 - protein, 16 aa, Artificial Sequence
  Description of Artificial Sequence: Synthetic peptide
AKDNSGYGYYYYGMDV

SEQ ID NO: 1665 - DNA, 321 bp, Artificial Sequence; identical to SEQ ID NO: 409
  Description of Artificial Sequence: Synthetic polynucleotide

SEQ ID NO: 1666 - protein, 107 aa, Artificial Sequence; identical to SEQ ID NO: 410
  Description of Artificial Sequence: Synthetic polypeptide

SEQ ID NO: 1667 - DNA, 18 bp, Artificial Sequence
  Description of Artificial Sequence: Synthetic oligonucleotide
cacagtgttagcaggaac

SEQ ID NO: 1668 - protein, 6 aa, Artificial Sequence
  Description of Artificial Sequence: Synthetic peptide
HSVSRN

SEQ ID NO: 1669 - DNA, 9 bp, Artificial Sequence
  Description of Artificial Sequence: Synthetic oligonucleotide
ggtgcatcc

SEQ ID NO: 1670 - protein, 3 aa, Artificial Sequence
  Description of Artificial Sequence: Synthetic peptide
GAS

SEQ ID NO: 1671 - DNA, 27 bp, Artificial Sequence
  Description of Artificial Sequence: Synthetic oligonucleotide
cagcagtataataattggcctctcact

SEQ ID NO: 1672 - protein, 9 aa, Artificial Sequence
  Description of Artificial Sequence: Synthetic peptide
QQYNNWPLT

SEQ ID NO: 1673 - DNA, 369 bp, Artificial Sequence; identical to SEQ ID NO: 513
  Description of Artificial Sequence: Synthetic polynucleotide

SEQ ID NO: 1674 - protein, 123 aa, Artificial Sequence; identical to SEQ ID NO: 514
  Description of Artificial Sequence: Synthetic polypeptide

SEQ ID NO: 1675 - DNA, 24 bp, Artificial Sequence
  Description of Artificial Sequence: Synthetic oligonucleotide
ggattcacctttgatgattatacc

SEQ ID NO: 1676 - protein, 8 aa, Artificial Sequence
  Description of Artificial Sequence: Synthetic peptide
GFTFDDYT

SEQ ID NO: 1677 - DNA, 24 bp, Artificial Sequence
  Description of Artificial Sequence: Synthetic oligonucleotide
attagttggaatagtggtagtata

SEQ ID NO: 1678 - protein, 8 aa, Artificial Sequence
  Description of Artificial Sequence: Synthetic peptide
ISWNSGSI

SEQ ID NO: 1679 - DNA, 48 bp, Artificial Sequence; identical to SEQ ID NO: 519
  Description of Artificial Sequence: Synthetic oligonucleotide

SEQ ID NO: 1680 - protein, 16 aa, Artificial Sequence
  Description of Artificial Sequence: Synthetic peptide
AKDNSGYGHYYYGMDV

SEQ ID NO: 1681 - DNA, 321 bp, Artificial Sequence; identical to SEQ ID NO: 521
  Description of Artificial Sequence: Synthetic polynucleotide

SEQ ID NO: 1682 - protein, 107 aa, Artificial Sequence; identical to SEQ ID NO: 522
  Description of Artificial Sequence: Synthetic polypeptide

SEQ ID NO: 1683 - DNA, 18 bp, Artificial Sequence
  Description of Artificial Sequence: Synthetic oligonucleotide
cagagtgttagcagcaac

SEQ ID NO: 1684 - protein, 6 aa, Artificial Sequence
  Description of Artificial Sequence: Synthetic peptide
QSVSSN

SEQ ID NO: 1685 - DNA, 9 bp, Artificial Sequence
  Description of Artificial Sequence: Synthetic oligonucleotide
ggtgcatcc

SEQ ID NO: 1686 - protein, 3 aa, Artificial Sequence
  Description of Artificial Sequence: Synthetic peptide
GAS

SEQ ID NO: 1687 - DNA, 27 bp, Artificial Sequence
  Description of Artificial Sequence: Synthetic oligonucleotide
cagcactatattaactggcctctcact

SEQ ID NO: 1688 - protein, 9 aa, Artificial Sequence
  Description of Artificial Sequence: Synthetic peptide
QHYINWPLT

SEQ ID NO: 1689 - DNA, 354 bp, Artificial Sequence; identical to SEQ ID NO: 577
  Description of Artificial Sequence: Synthetic polynucleotide

SEQ ID NO: 1690 - protein, 118 aa, Artificial Sequence; identical to SEQ ID NO: 578
  Description of Artificial Sequence: Synthetic polypeptide

SEQ ID NO: 1691 - DNA, 24 bp, Artificial Sequence
  Description of Artificial Sequence: Synthetic oligonucleotide
ggatttaccttcagaagttatgcc

SEQ ID NO: 1692 - protein, 8 aa, Artificial Sequence
  Description of Artificial Sequence: Synthetic peptide
GFTFRSYA

SEQ ID NO: 1693 - DNA, 24 bp, Artificial Sequence
  Description of Artificial Sequence: Synthetic oligonucleotide
gtatactatgatggaaataatcaa

SEQ ID NO: 1694 - protein, 8 aa, Artificial Sequence
  Description of Artificial Sequence: Synthetic peptide
VYYDGNNQ

SEQ ID NO: 1695 - DNA, 33 bp, Artificial Sequence; identical to SEQ ID NO: 551
  Description of Artificial Sequence: Synthetic oligonucleotide

SEQ ID NO: 1696 - protein, 11 aa, Artificial Sequence
  Description of Artificial Sequence: Synthetic peptide
ARGPGYNWLDP

SEQ ID NO: 1697 - DNA, 321 bp, Artificial Sequence; identical to SEQ ID NO: 585
  Description of Artificial Sequence: Synthetic polynucleotide

SEQ ID NO: 1698 - protein, 107 aa, Artificial Sequence; identical to SEQ ID NO: 586
  Description of Artificial Sequence: Synthetic polypeptide

SEQ ID NO: 1699 - DNA, 18 bp, Artificial Sequence
  Description of Artificial Sequence: Synthetic oligonucleotide
cagagtgttagcaggaac

SEQ ID NO: 1700 - protein, 6 aa, Artificial Sequence
  Description of Artificial Sequence: Synthetic peptide
QSVSRN

SEQ ID NO: 1701 - DNA, 9 bp, Artificial Sequence
  Description of Artificial Sequence: Synthetic oligonucleotide
ggtgcatcc

SEQ ID NO: 1702 - protein, 3 aa, Artificial Sequence
  Description of Artificial Sequence: Synthetic peptide
GAS

SEQ ID NO: 1703 - DNA, 27 bp, Artificial Sequence
  Description of Artificial Sequence: Synthetic oligonucleotide
cagcagtataataactggcctctcact

SEQ ID NO: 1704 - protein, 9 aa, Artificial Sequence
  Description of Artificial Sequence: Synthetic peptide
QQYNNWPLT

SEQ ID NO: 1705 - DNA, 354 bp, Artificial Sequence; identical to SEQ ID NO: 561
  Description of Artificial Sequence: Synthetic polynucleotide

SEQ ID NO: 1706 - protein, 118 aa, Artificial Sequence; identical to SEQ ID NO: 562
  Description of Artificial Sequence: Synthetic polypeptide

SEQ ID NO: 1707 - DNA, 24 bp, Artificial Sequence
  Description of Artificial Sequence: Synthetic oligonucleotide
ggattcaccttcagaagttatggc

SEQ ID NO: 1708 - protein, 8 aa, Artificial Sequence
  Description of Artificial Sequence: Synthetic peptide
GFTFRSYG

SEQ ID NO: 1709 - DNA, 24 bp, Artificial Sequence
  Description of Artificial Sequence: Synthetic oligonucleotide
atttactatgatggtaagaataaa

SEQ ID NO: 1710 - protein, 8 aa, Artificial Sequence
  Description of Artificial Sequence: Synthetic peptide
IYYDGKNK

SEQ ID NO: 1711 - DNA, 33 bp, Artificial Sequence; identical to SEQ ID NO: 567
  Description of Artificial Sequence: Synthetic oligonucleotide

SEQ ID NO: 1712 - protein, 11 aa, Artificial Sequence
  Description of Artificial Sequence: Synthetic peptide
ARGPGYNWLDP

SEQ ID NO: 1713 - DNA, 321 bp, Artificial Sequence; identical to SEQ ID NO: 569
  Description of Artificial Sequence: Synthetic polynucleotide

SEQ ID NO: 1714 - protein, 107 aa, Artificial Sequence; identical to SEQ ID NO: 570
  Description of Artificial Sequence: Synthetic polypeptide

SEQ ID NO: 1715 - DNA, 18 bp, Artificial Sequence
  Description of Artificial Sequence: Synthetic oligonucleotide
cagagaattagcagcaac

SEQ ID NO: 1716 - protein, 6 aa, Artificial Sequence
  Description of Artificial Sequence: Synthetic peptide
QRISSN

SEQ ID NO: 1717 - DNA, 9 bp, Artificial Sequence
  Description of Artificial Sequence: Synthetic oligonucleotide
ggtgcatcc

SEQ ID NO: 1718 - protein, 3 aa, Artificial Sequence
  Description of Artificial Sequence: Synthetic peptide
GAS

SEQ ID NO: 1719 - DNA, 27 bp, Artificial Sequence
  Description of Artificial Sequence: Synthetic oligonucleotide
cagcaacatcataactggcctctcact

SEQ ID NO: 1720 - protein, 9 aa, Artificial Sequence
  Description of Artificial Sequence: Synthetic peptide
QQHHNWPLT

SEQ ID NO: 1721 - protein, 119 aa, Artificial Sequence
  Description of Artificial Sequence: Synthetic polypeptide
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 1722 - protein, 8 aa, Artificial Sequence
  Description of Artificial Sequence: Synthetic peptide
GYTFTRYT

SEQ ID NO: 1723 - protein, 8 aa, Artificial Sequence
  Description of Artificial Sequence: Synthetic peptide
INPSRGYT

SEQ ID NO: 1724 - protein, 12 aa, Artificial Sequence
  Description of Artificial Sequence: Synthetic peptide
ARYYDDHYCLDY

SEQ ID NO: 1725 - protein, 106 aa, Artificial Sequence
  Description of Artificial Sequence: Synthetic polypeptide
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 1726 - protein, 11 aa, Artificial Sequence
  Description of Artificial Sequence: Synthetic peptide
LSCRASQSVSY

SEQ ID NO: 1727 - protein, 3 aa, Artificial Sequence
  Description of Artificial Sequence: Synthetic peptide
DTS

SEQ ID NO: 1728 - protein, 9 aa, Artificial Sequence
  Description of Artificial Sequence: Synthetic peptide
QQWSSNPLT

SEQ ID NO: 1729 - DNA, 372 bp, Artificial Sequence; identical to SEQ ID NO: 1609
  Description of Artificial Sequence: Synthetic polynucleotide

SEQ ID NO: 1730 - protein, 124 aa, Artificial Sequence; identical to SEQ ID NO: 1610
  Description of Artificial Sequence: Synthetic polypeptide

SEQ ID NO: 1731 - DNA, 24 bp, Artificial Sequence
  Description of Artificial Sequence: Synthetic oligonucleotide
gggtttacattcgacgattacagc

SEQ ID NO: 1732 - protein, 8 aa, Artificial Sequence
  Description of Artificial Sequence: Synthetic peptide
GFTFDDYS

SEQ ID NO: 1733 - DNA, 24 bp, Artificial Sequence
  Description of Artificial Sequence: Synthetic oligonucleotide
atatcatggaactcaggaagcaag

SEQ ID NO: 1734 - protein, 8 aa, Artificial Sequence
  Description of Artificial Sequence: Synthetic peptide
ISWNSGSK

SEQ ID NO: 1735 - DNA, 51 bp, Artificial Sequence; identical to SEQ ID NO: 1615
  Description of Artificial Sequence: Synthetic oligonucleotide

SEQ ID NO: 1736 - protein, 17 aa, Artificial Sequence
  Description of Artificial Sequence: Synthetic peptide
AKYGSGYGKFYHYGLDV

SEQ ID NO: 1737 - DNA, 372 bp, Artificial Sequence
  Description of Artificial Sequence: Synthetic polynucleotide
gaagtacagttggtagaatctggaggaggactcgtgcaaccaggacgatcattgcggttgagttgtgctgctagtggattcacattcgacgactatgctatgcattgggtaagacaggctccaggaaaaggactcgaatgggtgtcaggaataagttggaactccggaagcattgggtacgcagattcagtcaaagggcgattcaccatatcccgagataacgctaagaactcactttaccttcaaatgaactctcttcgagcagaggacactgcactttattattgcgctaaggacggctccggttatggatatttttattattatggaatggacgtatggggacaaggcactactgttaccgttagttcc

SEQ ID NO: 1738 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1739 - DNA, 24 bp, Artificial Sequence
  Description of Artificial Sequence: Synthetic oligonucleotide
ggattcacattcgacgactatgct

SEQ ID NO: 1740 - protein, 8 aa, Artificial Sequence
  Description of Artificial Sequence: Synthetic peptide
GFTFDDYA

SEQ ID NO: 1741 - DNA, 24 bp, Artificial Sequence
  Description of Artificial Sequence: Synthetic oligonucleotide
ataagttggaactccggaagcatt

SEQ ID NO: 1742 - protein, 8 aa, Artificial Sequence
  Description of Artificial Sequence: Synthetic peptide
ISWNSGSI

SEQ ID NO: 1743 - DNA, 51 bp, Artificial Sequence
  Description of Artificial Sequence: Synthetic oligonucleotide
gctaaggacggctccggttatggatatttttattattatggaatggacgta

SEQ ID NO: 1744 - protein, 17 aa, Artificial Sequence
  Description of Artificial Sequence: Synthetic peptide
AKDGSGYGYFYYYGMDV

SEQ ID NO: 1745 - DNA, 372 bp, Artificial Sequence; identical to SEQ ID NO: 1617
  Description of Artificial Sequence: Synthetic polynucleotide

SEQ ID NO: 1746 - protein, 124 aa, Artificial Sequence; identical to SEQ ID NO: 1618
  Description of Artificial Sequence: Synthetic polypeptide

SEQ ID NO: 1747 - DNA, 24 bp, Artificial Sequence
  Description of Artificial Sequence: Synthetic oligonucleotide
ggtttcactttcgacgattatagc

SEQ ID NO: 1748 - protein, 8 aa, Artificial Sequence
  Description of Artificial Sequence: Synthetic peptide
GFTFDDYS

SEQ ID NO: 1749 - DNA, 24 bp, Artificial Sequence
  Description of Artificial Sequence: Synthetic oligonucleotide
attagttggaactcaggaagtatt

SEQ ID NO: 1750 - protein, 8 aa, Artificial Sequence
  Description of Artificial Sequence: Synthetic peptide
ISWNSGSI

SEQ ID NO: 1751 - DNA, 51 bp, Artificial Sequence; identical to SEQ ID NO: 1623
  Description of Artificial Sequence: Synthetic oligonucleotide

SEQ ID NO: 1752 - protein, 17 aa, Artificial Sequence
  Description of Artificial Sequence: Synthetic peptide
AKDGSGYGYFYYYGMDV

SEQ ID NO: 1753 - DNA, 372 bp, Artificial Sequence
  Description of Artificial Sequence: Synthetic polynucleotide
gaagttcaacttgtggaaagtggcggaggattggttcaaccaggacgttcattgaggctttcatgcgcagcttccggatttacatttgacgattacgcaatgcactgggttagacaggcaccaggaaaaggactggagtgggtgagcgggatttcatggaacagcggcagtatcggttatgcagactcagttaaaggaagattcaccatcagtagagacaacgcaaaaaattccctttatctccaaatgaactctcttagggccgaagatacagcattgtactactgcgcaaaagacggatcaggttacggaaaattttactactatggtatggatgtatggggtcagggaaccacagtaactgtatcaagc

SEQ ID NO: 1754 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1755 - DNA, 24 bp, Artificial Sequence
  Description of Artificial Sequence: Synthetic oligonucleotide
ggatttacatttgacgattacgca

SEQ ID NO: 1756 - protein, 8 aa, Artificial Sequence
  Description of Artificial Sequence: Synthetic peptide
GFTFDDYA

SEQ ID NO: 1757 - DNA, 24 bp, Artificial Sequence
  Description of Artificial Sequence: Synthetic oligonucleotide
atttcatggaacagcggcagtatc

SEQ ID NO: 1758 - protein, 8 aa, Artificial Sequence
  Description of Artificial Sequence: Synthetic peptide
ISWNSGSI

SEQ ID NO: 1759 - DNA, 51 bp, Artificial Sequence
  Description of Artificial Sequence: Synthetic oligonucleotide
gcaaaagacggatcaggttacggaaaattttactactatggtatggatgta

SEQ ID NO: 1760 - protein, 17 aa, Artificial Sequence
  Description of Artificial Sequence: Synthetic peptide
AKDGSGYGKFYYYGMDV

SEQ ID NO: 1761 - DNA, 372 bp, Artificial Sequence; identical to SEQ ID NO: 1625
  Description of Artificial Sequence: Synthetic polynucleotide

SEQ ID NO: 1762 - protein, 124 aa, Artificial Sequence; identical to SEQ ID NO: 1626
  Description of Artificial Sequence: Synthetic polypeptide

SEQ ID NO: 1763 - DNA, 24 bp, Artificial Sequence
  Description of Artificial Sequence: Synthetic oligonucleotide
ggatttacatttgacgactattca

SEQ ID NO: 1764 - protein, 8 aa, Artificial Sequence
  Description of Artificial Sequence: Synthetic peptide
GFTFDDYS

SEQ ID NO: 1765 - DNA, 24 bp, Artificial Sequence
  Description of Artificial Sequence: Synthetic oligonucleotide
atatcttggaactcaggcagtatt

SEQ ID NO: 1766 - protein, 8 aa, Artificial Sequence
  Description of Artificial Sequence: Synthetic peptide
ISWNSGSI

SEQ ID NO: 1767 - DNA, 51 bp, Artificial Sequence; identical to SEQ ID NO: 1631
  Description of Artificial Sequence: Synthetic oligonucleotide

SEQ ID NO: 1768 - protein, 17 aa, Artificial Sequence
  Description of Artificial Sequence: Synthetic peptide
AKDGSGYGKFYYYGMDV

SEQ ID NO: 1769 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1770 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGLDVWGQGTTVTVSS

SEQ ID NO: 1771 - DNA, 24 bp, Artificial Sequence
  Description of Artificial Sequence: Synthetic oligonucleotide
gggtttacattcgacgattacagc

SEQ ID NO: 1772 - protein, 8 aa, Artificial Sequence
  Description of Artificial Sequence: Synthetic peptide
GFTFDDYS

SEQ ID NO: 1773 - DNA, 24 bp, Artificial Sequence
  Description of Artificial Sequence: Synthetic oligonucleotide
atatcatggaactcaggaagcatc

SEQ ID NO: 1774 - protein, 8 aa, Artificial Sequence
  Description of Artificial Sequence: Synthetic peptide
ISWNSGSI

SEQ ID NO: 1775 - DNA, 51 bp, Artificial Sequence; identical to SEQ ID NO: 1615
  Description of Artificial Sequence: Synthetic oligonucleotide

SEQ ID NO: 1776 - protein, 17 aa, Artificial Sequence
  Description of Artificial Sequence: Synthetic peptide
AKYGSGYGKFYHYGLDV

SEQ ID NO: 1777 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1778 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGLDVWGQGTTVTVSS

SEQ ID NO: 1779 - DNA, 24 bp, Artificial Sequence
  Description of Artificial Sequence: Synthetic oligonucleotide
gggtttacattcgacgattacagc

SEQ ID NO: 1780 - protein, 8 aa, Artificial Sequence
  Description of Artificial Sequence: Synthetic peptide
GFTFDDYS

SEQ ID NO: 1781 - DNA, 24 bp, Artificial Sequence
  Description of Artificial Sequence: Synthetic oligonucleotide
atatcatggaactcaggaagcaag

SEQ ID NO: 1782 - protein, 8 aa, Artificial Sequence
  Description of Artificial Sequence: Synthetic peptide
ISWNSGSK

SEQ ID NO: 1783 - DNA, 51 bp, Artificial Sequence
  Description of Artificial Sequence: Synthetic oligonucleotide
gcaaaagacggcagtggttatggcaagttttatcattatggactggacgtg

SEQ ID NO: 1784 - protein, 17 aa, Artificial Sequence
  Description of Artificial Sequence: Synthetic peptide
AKDGSGYGKFYHYGLDV

SEQ ID NO: 1785 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1786 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGLDVWGQGTTVTVSS

SEQ ID NO: 1787 - DNA, 24 bp, Artificial Sequence
  Description of Artificial Sequence: Synthetic oligonucleotide
gggtttacattcgacgattacagc

SEQ ID NO: 1788 - protein, 8 aa, Artificial Sequence
  Description of Artificial Sequence: Synthetic peptide
GFTFDDYS

SEQ ID NO: 1789 - DNA, 24 bp, Artificial Sequence
  Description of Artificial Sequence: Synthetic oligonucleotide
atatcatggaactcaggaagcaag

SEQ ID NO: 1790 - protein, 8 aa, Artificial Sequence
  Description of Artificial Sequence: Synthetic peptide
ISWNSGSK

SEQ ID NO: 1791 - DNA, 51 bp, Artificial Sequence
  Description of Artificial Sequence: Synthetic oligonucleotide
gcaaaatacggcagtggttatggcaagttttattattatggactggacgtg

SEQ ID NO: 1792 - protein, 17 aa, Artificial Sequence
  Description of Artificial Sequence: Synthetic peptide
AKYGSGYGKFYYYGLDV

SEQ ID NO: 1793 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1794 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGMDVWGQGTTVTVSS

SEQ ID NO: 1795 - DNA, 24 bp, Artificial Sequence
  Description of Artificial Sequence: Synthetic oligonucleotide
gggtttacattcgacgattacagc

SEQ ID NO: 1796 - protein, 8 aa, Artificial Sequence
  Description of Artificial Sequence: Synthetic peptide
GFTFDDYS

SEQ ID NO: 1797 - DNA, 24 bp, Artificial Sequence
  Description of Artificial Sequence: Synthetic oligonucleotide
atatcatggaactcaggaagcaag

SEQ ID NO: 1798 - protein, 8 aa, Artificial Sequence
  Description of Artificial Sequence: Synthetic peptide
ISWNSGSK

SEQ ID NO: 1799 - DNA, 51 bp, Artificial Sequence
  Description of Artificial Sequence: Synthetic oligonucleotide
gcaaaatacggcagtggttatggcaagttttatcattatggaatggacgtg

SEQ ID NO: 1800 - protein, 17 aa, Artificial Sequence
  Description of Artificial Sequence: Synthetic peptide
AKYGSGYGKFYHYGMDV

SEQ ID NO: 1801 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1802 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGLDVWGQGTTVTVSS

SEQ ID NO: 1803 - DNA, 24 bp, Artificial Sequence
  Description of Artificial Sequence: Synthetic oligonucleotide
gggtttacattcgacgattacagc

SEQ ID NO: 1804 - protein, 8 aa, Artificial Sequence
  Description of Artificial Sequence: Synthetic peptide
GFTFDDYS

SEQ ID NO: 1805 - DNA, 24 bp, Artificial Sequence
  Description of Artificial Sequence: Synthetic oligonucleotide
atatcatggaactcaggaagcatc

SEQ ID NO: 1806 - protein, 8 aa, Artificial Sequence
  Description of Artificial Sequence: Synthetic peptide
ISWNSGSI

SEQ ID NO: 1807 - DNA, 51 bp, Artificial Sequence; identical to SEQ ID NO: 1783
  Description of Artificial Sequence: Synthetic oligonucleotide

SEQ ID NO: 1808 - protein, 17 aa, Artificial Sequence
  Description of Artificial Sequence: Synthetic peptide
AKDGSGYGKFYHYGLDV

SEQ ID NO: 1809 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1810 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGLDVWGQGTTVTVSS

SEQ ID NO: 1811 - DNA, 24 bp, Artificial Sequence
  Description of Artificial Sequence: Synthetic oligonucleotide
gggtttacattcgacgattacagc

SEQ ID NO: 1812 - protein, 8 aa, Artificial Sequence
  Description of Artificial Sequence: Synthetic peptide
GFTFDDYS

SEQ ID NO: 1813 - DNA, 24 bp, Artificial Sequence
  Description of Artificial Sequence: Synthetic oligonucleotide
atatcatggaactcaggaagcatc

SEQ ID NO: 1814 - protein, 8 aa, Artificial Sequence
  Description of Artificial Sequence: Synthetic peptide
ISWNSGSI

SEQ ID NO: 1815 - DNA, 51 bp, Artificial Sequence; identical to SEQ ID NO: 1791
  Description of Artificial Sequence: Synthetic oligonucleotide

SEQ ID NO: 1816 - protein, 17 aa, Artificial Sequence
  Description of Artificial Sequence: Synthetic peptide
AKYGSGYGKFYYYGLDV

SEQ ID NO: 1817 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1818 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGMDVWGQGTTVTVSS

SEQ ID NO: 1819 - DNA, 24 bp, Artificial Sequence
  Description of Artificial Sequence: Synthetic oligonucleotide
gggtttacattcgacgattacagc

SEQ ID NO: 1820 - protein, 8 aa, Artificial Sequence
  Description of Artificial Sequence: Synthetic peptide
GFTFDDYS

SEQ ID NO: 1821 - DNA, 24 bp, Artificial Sequence
  Description of Artificial Sequence: Synthetic oligonucleotide
atatcatggaactcaggaagcatc

SEQ ID NO: 1822 - protein, 8 aa, Artificial Sequence
  Description of Artificial Sequence: Synthetic peptide
ISWNSGSI

SEQ ID NO: 1823 - DNA, 51 bp, Artificial Sequence; identical to SEQ ID NO: 1799
  Description of Artificial Sequence: Synthetic oligonucleotide

SEQ ID NO: 1824 - protein, 17 aa, Artificial Sequence
  Description of Artificial Sequence: Synthetic peptide
AKYGSGYGKFYHYGMDV

SEQ ID NO: 1825 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1826 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGLDVWGQGTTVTVSS

SEQ ID NO: 1827 - DNA, 24 bp, Artificial Sequence
  Description of Artificial Sequence: Synthetic oligonucleotide
gggtttacattcgacgattacagc

SEQ ID NO: 1828 - protein, 8 aa, Artificial Sequence
  Description of Artificial Sequence: Synthetic peptide
GFTFDDYS

SEQ ID NO: 1829 - DNA, 24 bp, Artificial Sequence
  Description of Artificial Sequence: Synthetic oligonucleotide
atatcatggaactcaggaagcaag

SEQ ID NO: 1830 - protein, 8 aa, Artificial Sequence
  Description of Artificial Sequence: Synthetic peptide
ISWNSGSK

SEQ ID NO: 1831 - DNA, 51 bp, Artificial Sequence
  Description of Artificial Sequence: Synthetic oligonucleotide
gcaaaagacggcagtggttatggcaagttttattattatggactggacgtg

SEQ ID NO: 1832 - protein, 17 aa, Artificial Sequence
  Description of Artificial Sequence: Synthetic peptide
AKDGSGYGKFYYYGLDV

SEQ ID NO: 1833 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1834 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGMDVWGQGTTVTVSS

SEQ ID NO: 1835 - DNA, 24 bp, Artificial Sequence
  Description of Artificial Sequence: Synthetic oligonucleotide
gggtttacattcgacgattacagc

SEQ ID NO: 1836 - protein, 8 aa, Artificial Sequence
  Description of Artificial Sequence: Synthetic peptide
GFTFDDYS

SEQ ID NO: 1837 - DNA, 24 bp, Artificial Sequence
  Description of Artificial Sequence: Synthetic oligonucleotide
atatcatggaactcaggaagcaag

SEQ ID NO: 1838 - protein, 8 aa, Artificial Sequence
  Description of Artificial Sequence: Synthetic peptide
ISWNSGSK

SEQ ID NO: 1839 - DNA, 51 bp, Artificial Sequence
  Description of Artificial Sequence: Synthetic oligonucleotide
gcaaaagacggcagtggttatggcaagttttatcattatggaatggacgtg

SEQ ID NO: 1840 - protein, 17 aa, Artificial Sequence
  Description of Artificial Sequence: Synthetic peptide
AKDGSGYGKFYHYGMDV

SEQ ID NO: 1841 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1842 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGMDVWGQGTTVTVSS

SEQ ID NO: 1843 - DNA, 24 bp, Artificial Sequence
  Description of Artificial Sequence: Synthetic oligonucleotide
gggtttacattcgacgattacagc

SEQ ID NO: 1844 - protein, 8 aa, Artificial Sequence
  Description of Artificial Sequence: Synthetic peptide
GFTFDDYS

SEQ ID NO: 1845 - DNA, 24 bp, Artificial Sequence
  Description of Artificial Sequence: Synthetic oligonucleotide
atatcatggaactcaggaagcaag

SEQ ID NO: 1846 - protein, 8 aa, Artificial Sequence
  Description of Artificial Sequence: Synthetic peptide
ISWNSGSK

SEQ ID NO: 1847 - DNA, 51 bp, Artificial Sequence
  Description of Artificial Sequence: Synthetic oligonucleotide
gcaaaatacggcagtggttatggcaagttttattattatggaatggacgtg

SEQ ID NO: 1848 - protein, 17 aa, Artificial Sequence
  Description of Artificial Sequence: Synthetic peptide
AKYGSGYGKFYYYGMDV

SEQ ID NO: 1849 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1850 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGLDVWGQGTTVTVSS

SEQ ID NO: 1851 - DNA, 24 bp, Artificial Sequence
  Description of Artificial Sequence: Synthetic oligonucleotide
gggtttacattcgacgattacagc

SEQ ID NO: 1852 - protein, 8 aa, Artificial Sequence
  Description of Artificial Sequence: Synthetic peptide
GFTFDDYS

SEQ ID NO: 1853 - DNA, 24 bp, Artificial Sequence
  Description of Artificial Sequence: Synthetic oligonucleotide
atatcatggaactcaggaagcatc

SEQ ID NO: 1854 - protein, 8 aa, Artificial Sequence
  Description of Artificial Sequence: Synthetic peptide
ISWNSGSI

SEQ ID NO: 1855 - DNA, 51 bp, Artificial Sequence; identical to SEQ ID NO: 1831
  Description of Artificial Sequence: Synthetic oligonucleotide

SEQ ID NO: 1856 - protein, 17 aa, Artificial Sequence
  Description of Artificial Sequence: Synthetic peptide
AKDGSGYGKFYYYGLDV

SEQ ID NO: 1857 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1858 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGMDVWGQGTTVTVSS

SEQ ID NO: 1859 - DNA, 24 bp, Artificial Sequence
  Description of Artificial Sequence: Synthetic oligonucleotide
gggtttacattcgacgattacagc

SEQ ID NO: 1860 - protein, 8 aa, Artificial Sequence
  Description of Artificial Sequence: Synthetic peptide
GFTFDDYS

SEQ ID NO: 1861 - DNA, 24 bp, Artificial Sequence
  Description of Artificial Sequence: Synthetic oligonucleotide
atatcatggaactcaggaagcatc

SEQ ID NO: 1862 - protein, 8 aa, Artificial Sequence
  Description of Artificial Sequence: Synthetic peptide
ISWNSGSI

SEQ ID NO: 1863 - DNA, 51 bp, Artificial Sequence; identical to SEQ ID NO: 1839
  Description of Artificial Sequence: Synthetic oligonucleotide

SEQ ID NO: 1864 - protein, 17 aa, Artificial Sequence
  Description of Artificial Sequence: Synthetic peptide
AKDGSGYGKFYHYGMDV

SEQ ID NO: 1865 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1866 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGMDVWGQGTTVTVSS

SEQ ID NO: 1867 - DNA, 24 bp, Artificial Sequence
  Description of Artificial Sequence: Synthetic oligonucleotide
gggtttacattcgacgattacagc

SEQ ID NO: 1868 - protein, 8 aa, Artificial Sequence
  Description of Artificial Sequence: Synthetic peptide
GFTFDDYS

SEQ ID NO: 1869 - DNA, 24 bp, Artificial Sequence
  Description of Artificial Sequence: Synthetic oligonucleotide
atatcatggaactcaggaagcatc

SEQ ID NO: 1870 - protein, 8 aa, Artificial Sequence
  Description of Artificial Sequence: Synthetic peptide
ISWNSGSI

SEQ ID NO: 1871 - DNA, 51 bp, Artificial Sequence; identical to SEQ ID NO: 1847
  Description of Artificial Sequence: Synthetic oligonucleotide

SEQ ID NO: 1872 - protein, 17 aa, Artificial Sequence
  Description of Artificial Sequence: Synthetic peptide
AKYGSGYGKFYYYGMDV

SEQ ID NO: 1873 - DNA, 372 bp, Artificial Sequence
  Description of Artificial Sequence: Synthetic polynucleotide
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggaatggacgtgtggggacaagggacaacagtgacagtgagtagc

SEQ ID NO: 1874 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGMDVWGQGTTVTVSS

SEQ ID NO: 1875 - DNA, 24 bp, Artificial Sequence
  Description of Artificial Sequence: Synthetic oligonucleotide
gggtttacattcgacgattacagc

SEQ ID NO: 1876 - protein, 8 aa, Artificial Sequence
  Description of Artificial Sequence: Synthetic peptide
GFTFDDYS

SEQ ID NO: 1877 - DNA, 24 bp, Artificial Sequence
  Description of Artificial Sequence: Synthetic oligonucleotide
atatcatggaactcaggaagcaag

SEQ ID NO: 1878 - protein, 8 aa, Artificial Sequence
  Description of Artificial Sequence: Synthetic peptide
ISWNSGSK

SEQ ID NO: 1879 - DNA, 51 bp, Artificial Sequence
  Description of Artificial Sequence: Synthetic oligonucleotide
gcaaaagacggcagtggttatggcaagttttattattatggaatggacgtg

SEQ ID NO: 1880 - protein, 17 aa, Artificial Sequence
  Description of Artificial Sequence: Synthetic peptide
AKDGSGYGKFYYYGMDV

SEQ ID NO: 1881 - DNA, 372 bp, Artificial Sequence
  Description of Artificial Sequence: Synthetic polynucleotide
gaagtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1882 - protein, 124 aa, Artificial Sequence; identical to SEQ ID NO: 1506
  Description of Artificial Sequence: Synthetic polypeptide

SEQ ID NO: 1883 - DNA, 24 bp, Artificial Sequence
  Description of Artificial Sequence: Synthetic oligonucleotide
ggattcacctttgatgattattcc

SEQ ID NO: 1884 - protein, 8 aa, Artificial Sequence
  Description of Artificial Sequence: Synthetic peptide
GFTFDDYS

SEQ ID NO: 1885 - DNA, 24 bp, Artificial Sequence
  Description of Artificial Sequence: Synthetic oligonucleotide
attagttggaatagtggtagcaaa

SEQ ID NO: 1886 - protein, 8 aa, Artificial Sequence
  Description of Artificial Sequence: Synthetic peptide
ISWNSGSK

SEQ ID NO: 1887 - DNA, 51 bp, Artificial Sequence; identical to SEQ ID NO: 1511
  Description of Artificial Sequence: Synthetic oligonucleotide

SEQ ID NO: 1888 - protein, 17 aa, Artificial Sequence
  Description of Artificial Sequence: Synthetic peptide
AKYGSGYGKFYHYGLDV

SEQ ID NO: 1889 - DNA, 324 bp, Artificial Sequence
  Description of Artificial Sequence: Synthetic polynucleotide
gacatccagatgacccagtctccatcctccctgtctgcatctgttggagacagcgtcaccatcacttgccgggcaagtcagagcattaacaactatttaaattggtatcagcagaaaccagggaaagcccctaagctcctgatctatactgcatccagtttgctaagtggggtcccttcaaggttcagtggcagtggatctgggacagatttcactctcaccatcagcggtctgcaccctgaagattttgcaacttacttctgtcaacagagtttcagtacccctccgatcaccttcggccaagggacacgactggacattaaa

SEQ ID NO: 1890 - protein, 108 aa, Artificial Sequence
  Description of Artificial Sequence: Synthetic polypeptide
DIQMTQSPSSLSASVGDSVTITCRASQSINNYLNWYQQKPGKAPKLLIYTASSLLSGVPSRFSGSGSGTDFTLTISGLHPEDFATYFCQQSFSTPPITFGQGTRLDIK

SEQ ID NO: 1891 - DNA, 18 bp, Artificial Sequence
  Description of Artificial Sequence: Synthetic oligonucleotide
cagagcattaacaactat

SEQ ID NO: 1892 - protein, 6 aa, Artificial Sequence
  Description of Artificial Sequence: Synthetic peptide
QSINNY

SEQ ID NO: 1893 - DNA, 9 bp, Artificial Sequence
  Description of Artificial Sequence: Synthetic oligonucleotide
actgcatcc

SEQ ID NO: 1894 - protein, 3 aa, Artificial Sequence
  Description of Artificial Sequence: Synthetic peptide
TAS

SEQ ID NO: 1895 - DNA, 30 bp, Artificial Sequence
  Description of Artificial Sequence: Synthetic oligonucleotide
caacagagtttcagtacccctccgatcacc

SEQ ID NO: 1896 - protein, 10 aa, Artificial Sequence
  Description of Artificial Sequence: Synthetic peptide
QQSFSTPPIT

SEQ ID NO: 1897 - protein, 207 aa, Artificial Sequence
  Description of Artificial Sequence: Synthetic polypeptide
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1898 - protein, 171 aa, Artificial Sequence
  Description of Artificial Sequence: Synthetic polypeptide
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 1899 - protein, 490 aa, Homo sapiens
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 1900 - protein, 207 aa, Artificial Sequence; identical to SEQ ID NO: 1897
  Description of Artificial Sequence: Synthetic polypeptide

SEQ ID NO: 1901 - protein, 171 aa, Artificial Sequence; identical to SEQ ID NO: 1898
  Description of Artificial Sequence: Synthetic polypeptide

SEQ ID NO: 1902 - skipped

SEQ ID NO: 1903 - protein, 25 aa, Artificial Sequence [sequence omitted]

SEQ ID NO: 1904 - protein, 17 aa, Artificial Sequence
  Description of Artificial Sequence: Synthetic peptide
MHWVRQAPGKGLEWVSG

SEQ ID NO: 1905 - protein, 38 aa, Artificial Sequence
  Description of Artificial Sequence: Synthetic polypeptide
GYADSVKGRFTISRDNAKNSLYLQMNSLRAEDTALYYC

SEQ ID NO: 1906 - protein, 11 aa, Artificial Sequence
  Description of Artificial Sequence: Synthetic peptide
WGQGTTVTVSS

SEQ ID NO: 1907 - protein, 8 aa, Artificial Sequence
  Description of Artificial Sequence: Synthetic peptide
  MOD_RES (8)..(8): Any amino acid
GFTFDDYX

SEQ ID NO: 1908 - protein, 8 aa, Artificial Sequence
  Description of Artificial Sequence: Synthetic peptide
  MOD_RES (8)..(8): Any amino acid
ISWNSGSX

SEQ ID NO: 1909 - protein, 17 aa, Artificial Sequence
  Description of Artificial Sequence: Synthetic peptide
  MOD_RES (3)..(3): Any amino acid
  MOD_RES (12)..(12): Any amino acid
  MOD_RES (15)..(15): Any amino acid
AKXGSGYGKFYXYGXDV

SEQ ID NO: 1910 - protein, 125 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSGYGYFYYYGMDVWGQGTTVTVSS

SEQ ID NO: 1911 - protein, 330 aa, Artificial Sequence [sequence omitted]

SEQ ID NO: 1912 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1913 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1914 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1915 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1916 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1917 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1918 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1919 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1920 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1921 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1922 - protein, 232 aa, Artificial Sequence
  Description of Artificial Sequence: Synthetic polypeptide
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1923 - protein, 228 aa, Artificial Sequence
  Description of Artificial Sequence: Synthetic polypeptide
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1924 - protein, 228 aa, Artificial Sequence
  Description of Artificial Sequence: Synthetic polypeptide
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1925 - protein, 229 aa, Artificial Sequence
  Description of Artificial Sequence: Synthetic polypeptide
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1926 - protein, 229 aa, Artificial Sequence
  Description of Artificial Sequence: Synthetic polypeptide
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1927 - protein, 231 aa, Artificial Sequence
  Description of Artificial Sequence: Synthetic polypeptide
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1928 - protein, 231 aa, Artificial Sequence
  Description of Artificial Sequence: Synthetic polypeptide
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1929 - protein, 228 aa, Artificial Sequence
  Description of Artificial Sequence: Synthetic polypeptide
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1930 - protein, 228 aa, Artificial Sequence
  Description of Artificial Sequence: Synthetic polypeptide
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1931 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1932 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1933 - protein, 233 aa, Artificial Sequence
  Description of Artificial Sequence: Synthetic polypeptide
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNRFTTKSFSRTPGK

SEQ ID NO: 1934 - protein, 233 aa, Artificial Sequence
  Description of Artificial Sequence: Synthetic polypeptide
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1935 - protein, 4 aa, Artificial Sequence
  Description of Artificial Sequence: Synthetic peptide
  MOD_RES (1)..(2): Any amino acid
  MOD_RES (4)..(4): Any amino acid
XXQX

SEQ ID NO: 1936 - protein, 5 aa, Artificial Sequence
  Description of Artificial Sequence: Synthetic peptide
LLQGG

SEQ ID NO: 1937 - protein, 4 aa, Artificial Sequence
  Description of Artificial Sequence: Synthetic peptide
LLQG

SEQ ID NO: 1938 - protein, 6 aa, Artificial Sequence
  Description of Artificial Sequence: Synthetic peptide
LSLSQG

SEQ ID NO: 1939 - protein, 8 aa, Artificial Sequence
  Description of Artificial Sequence: Synthetic peptide
GGGLLQGG

SEQ ID NO: 1940 - protein, 5 aa, Artificial Sequence
  Description of Artificial Sequence: Synthetic peptide
GLLQG

SEQ ID NO: 1941 - protein, 10 aa, Artificial Sequence
  Description of Artificial Sequence: Synthetic peptide
GSPLAQSHGG

SEQ ID NO: 1942 - protein, 7 aa, Artificial Sequence
  Description of Artificial Sequence: Synthetic peptide
GLLQGGG

SEQ ID NO: 1943 - protein, 6 aa, Artificial Sequence
  Description of Artificial Sequence: Synthetic peptide
GLLQGG

SEQ ID NO: 1944 - protein, 4 aa, Artificial Sequence
  Description of Artificial Sequence: Synthetic peptide
GLLQ

SEQ ID NO: 1945 - protein, 8 aa, Artificial Sequence
  Description of Artificial Sequence: Synthetic peptide
LLQLLQGA

SEQ ID NO: 1946 - protein, 5 aa, Artificial Sequence
  Description of Artificial Sequence: Synthetic peptide
LLQGA

SEQ ID NO: 1947 - protein, 7 aa, Artificial Sequence
  Description of Artificial Sequence: Synthetic peptide
LLQYQGA

SEQ ID NO: 1948 - protein, 6 aa, Artificial Sequence
  Description of Artificial Sequence: Synthetic peptide
LLQGSG

SEQ ID NO: 1949 - protein, 6 aa, Artificial Sequence
  Description of Artificial Sequence: Synthetic peptide
LLQYQG

SEQ ID NO: 1950 - protein, 7 aa, Artificial Sequence
  Description of Artificial Sequence: Synthetic peptide
LLQLLQG

SEQ ID NO: 1951 - protein, 5 aa, Artificial Sequence
  Description of Artificial Sequence: Synthetic peptide
SLLQG

SEQ ID NO: 1952 - protein, 5 aa, Artificial Sequence
  Description of Artificial Sequence: Synthetic peptide
LLQLQ

SEQ ID NO: 1953 - protein, 6 aa, Artificial Sequence
  Description of Artificial Sequence: Synthetic peptide
LLQLLQ

SEQ ID NO: 1954 - protein, 5 aa, Artificial Sequence
  Description of Artificial Sequence: Synthetic peptide
LLQGR

SEQ ID NO: 1955 - DNA, 372 bp, Homo sapiens
caggtgcagctgcaggagtcgggcccaggactggtgaagccttcggagaccctgtccctcacctgcactgtctctggtgactccatcagtagttactattggacctggatccggcagcccccagggaagggactggagtggattgggtatatcttttacagggggggcaccacctacaacccctccctcaagagtcgagtcaccatatcagtagacacgtccaagaaccagttctccctgaagttgaggtctgtgaccgccgcagacacggccgtgtattactgtgcgaggggagacgatcttttagtggtgacaagtgtctactggtacatcgatctctggggccgtggcaccctggtcaccgtctcctca

SEQ ID NO: 1956 - protein, 124 aa, Homo sapiens
QVQLQESGPGLVKPSETLSLTCTVSGDSISSYYWTWIRQPPGKGLEWIGYIFYRGGTTYNPSLKSRVTISVDTSKNQFSLKLRSVTAADTAVYYCARGDDLLVVTSVYWYIDLWGRGTLVTVSS

SEQ ID NO: 1957 - DNA, 24 bp, Homo sapiens
ggtgactccatcagtagttactat

SEQ ID NO: 1958 - protein, 8 aa, Homo sapiens
GDSISSYY

SEQ ID NO: 1959 - DNA, 21 bp, Homo sapiens
atcttttacagggggggcacc

SEQ ID NO: 1960 - protein, 7 aa, Homo sapiens
IFYRGGT

SEQ ID NO: 1961 - DNA, 54 bp, Homo sapiens
gcgaggggagacgatcttttagtggtgacaagtgtctactggtacatcgatctc

SEQ ID NO: 1962 - protein, 18 aa, Homo sapiens
ARGDDLLVVTSVYWYIDL

SEQ ID NO: 1963 - DNA, 360 bp, Homo sapiens
caggtgcagctggtggagtctgggggaggcgtggtccagcctggggggtccctgagactctcctgtgcagcgtccggattcaccttcagtggctatggcatgcactgggtccgccaggctccaggcaaggggctggagtggatggcagttatatggtatgatggaagtaatgattactatccagactccgtgaagggccgattcaccatctccagagacaattccaagaacacgctgtatctgcaaatgaacagcctgagagtcgaggacacggctgtgtattactgtgcgcgagatgcgtgggacctactacgttcctttgactactggggccagggaaccctggtcaccgtctcctca

SEQ ID NO: 1964 - protein, 120 aa, Homo sapiens
QVQLVESGGGVVQPGGSLRLSCAASGFTFSGYGMHWVRQAPGKGLEWMAVIWYDGSNDYYPDSVKGRFTISRDNSKNTLYLQMNSLRVEDTAVYYCARDAWDLLRSFDYWGQGTLVTVSS

SEQ ID NO: 1965 - DNA, 24 bp, Homo sapiens
ggattcaccttcagtggctatggc

SEQ ID NO: 1966 - protein, 8 aa, Homo sapiens
GFTFSGYG

SEQ ID NO: 1967 - DNA, 24 bp, Homo sapiens
atatggtatgatggaagtaatgat

SEQ ID NO: 1968 - protein, 8 aa, Homo sapiens
IWYDGSND

SEQ ID NO: 1969 - DNA, 39 bp, Homo sapiens
gcgcgagatgcgtgggacctactacgttcctttgactac

SEQ ID NO: 1970 - protein, 13 aa, Homo sapiens
ARDAWDLLRSFDY

SEQ ID NO: 1971 - DNA, 363 bp, Homo sapiens
caggtgcagctggtggagtctgggggaggcgtggtccagcctgggaggtccctgagagtctcttgtgtagtgtctggattcaccttcagcagctttggcatgcattgggtccgccaggctccagacaaggggctggagtgggtggcagttatatggtatgatggaagtaatgattactattcagactccgtgaagggccgattcaccatctccagagacaattccaagaacacgctgtttctacaaatgaaccgcctgagagccgaagacacggctgtttattactgtgcgcgagctaataactggaaccgttttgatgcctttgatctctggggccaagggacaatggtcaccgtctcttca

SEQ ID NO: 1972 - protein, 121 aa, Homo sapiens
QVQLVESGGGVVQPGRSLRVSCVVSGFTFSSFGMHWVRQAPDKGLEWVAVIWYDGSNDYYSDSVKGRFTISRDNSKNTLFLQMNRLRAEDTAVYYCARANNWNRFDAFDLWGQGTMVTVSS

SEQ ID NO: 1973 - DNA, 24 bp, Homo sapiens
ggattcaccttcagcagctttggc

SEQ ID NO: 1974 - protein, 8 aa, Homo sapiens
GFTFSSFG

SEQ ID NO: 1975 - DNA, 24 bp, Homo sapiens
atatggtatgatggaagtaatgat

SEQ ID NO: 1976 - protein, 8 aa, Homo sapiens
IWYDGSND

SEQ ID NO: 1977 - DNA, 42 bp, Homo sapiens
gcgcgagctaataactggaaccgttttgatgcctttgatctc

SEQ ID NO: 1978 - protein, 14 aa, Homo sapiens
ARANNWNRFDAFDL

SEQ ID NO: 1979 - DNA, 372 bp, Homo sapiens
gaggtgcagctggtggagtctgggggaggcttggttcagcctggagggtccctgagactctcctgtgcagcctctggattcatcttcagtaattatgaaatgaactgggtccgccaggctccagggaagggactggaatggatttcatacattactagtagtggtaatatgaaatattacgcagactctgtgaagggccgattcaccatctccagagacaacgacaagaattcactgtatctgcaaatgagtagtctgagagtcgaggacacggctgtttattattgtgtgagaggagggcgatttttggagtggttgacctactacgttatggtcgtctggggccaagggaccacggtcaccgtctcctca

SEQ ID NO: 1980 - protein, 124 aa, Homo sapiens
EVQLVESGGGLVQPGGSLRLSCAASGFIFSNYEMNWVRQAPGKGLEWISYITSSGNMKYYADSVKGRFTISRDNDKNSLYLQMSSLRVEDTAVYYCVRGGRFLEWLTYYVMVVWGQGTTVTVSS

SEQ ID NO: 1981 - DNA, 24 bp, Homo sapiens
ggattcatcttcagtaattatgaa

SEQ ID NO: 1982 - protein, 8 aa, Homo sapiens
GFIFSNYE

SEQ ID NO: 1983 - DNA, 24 bp, Homo sapiens
attactagtagtggtaatatgaaa

SEQ ID NO: 1984 - protein, 8 aa, Homo sapiens
ITSSGNMK

SEQ ID NO: 1985 - DNA, 51 bp, Homo sapiens
gtgagaggagggcgatttttggagtggttgacctactacgttatggtcgtc

SEQ ID NO: 1986 - protein, 17 aa, Homo sapiens
VRGGRFLEWLTYYVMVV

SEQ ID NO: 1987 - DNA, 360 bp, Homo sapiens
caggtgcagctggtggagtctgggggaggcgtggtccagcctgggaggtccctgagactctcctgtgcagtgtctggattcaccttcagtagctatggcatgcactgggtccgccaggctccaggcaaggggctggagtgggtggcaaatatttggtatgatggaactaatgattactatccatactccgtgaagggccgattcaccatctccagagacaattcccagaacacactatatctgcaaatgaacagcctgagagccgaggacacggctgtatattactgtgcgagagaggacttcattaactaccggtcttttgactattggggccagggaaccctggtcaccgtctcctca

SEQ ID NO: 1988 - protein, 120 aa, Homo sapiens
QVQLVESGGGVVQPGRSLRLSCAVSGFTFSSYGMHWVRQAPGKGLEWVANIWYDGTNDYYPYSVKGRFTISRDNSQNTLYLQMNSLRAEDTAVYYCAREDFINYRSFDYWGQGTLVTVSS

SEQ ID NO: 1989 - DNA, 24 bp, Homo sapiens
ggattcaccttcagtagctatggc

SEQ ID NO: 1990 - protein, 8 aa, Homo sapiens
GFTFSSYG

SEQ ID NO: 1991 - DNA, 24 bp, Homo sapiens
atttggtatgatggaactaatgat

SEQ ID NO: 1992 - protein, 8 aa, Homo sapiens
IWYDGTND

SEQ ID NO: 1993 - DNA, 39 bp, Homo sapiens
gcgagagaggacttcattaactaccggtcttttgactat

SEQ ID NO: 1994 - protein, 13 aa, Homo sapiens
AREDFINYRSFDY

SEQ ID NO: 1995 - DNA, 372 bp, Homo sapiens
caggtgcagctggtggagtctgggggaggcgtggtccagccagggacgtccctgagactctcctgtgtcgcgtctggattcaccttcagaaattttggaatgcactgggtccgccaggctccaggcaaggggctggagtgggtggcaaatatatggtttgacggaagtaatgagaactatgtcgagtccattcagggccgattcaccatctccagagacaattccaagaacacactgaatctgcagatgaacagcctgagagccgaggactcggctgtctattactgtgtgagagagggaatcctaggaactactaatccttatgatgcttttgatgtctggggccaagggacaatggtcaccgtctcttca

SEQ ID NO: 1996 - protein, 124 aa, Homo sapiens
QVQLVESGGGVVQPGTSLRLSCVASGFTFRNFGMHWVRQAPGKGLEWVANIWFDGSNENYVESIQGRFTISRDNSKNTLNLQMNSLRAEDSAVYYCVREGILGTTNPYDAFDVWGQGTMVTVSS

SEQ ID NO: 1997 - DNA, 24 bp, Homo sapiens
ggattcaccttcagaaattttgga

SEQ ID NO: 1998 - protein, 8 aa, Homo sapiens
GFTFRNFG

SEQ ID NO: 1999 - DNA, 24 bp, Homo sapiens
atatggtttgacggaagtaatgag

SEQ ID NO: 2000 - protein, 8 aa, Homo sapiens
IWFDGSNE

SEQ ID NO: 2001 - DNA, 51 bp, Homo sapiens
gtgagagagggaatcctaggaactactaatccttatgatgcttttgatgtc

SEQ ID NO: 2002 - protein, 17 aa, Homo sapiens
VREGILGTTNPYDAFDV

SEQ ID NO: 2003 - DNA, 378 bp, Homo sapiens
caggtgcagctggtggagtctgggggaggcgtggtccagcctgggaggtccctgagactctcctgtgcagcgtctggattcacctttagtaactttggaatgcactgggtccgccaggcgccaggcaagggactggagtgggtggcaggtatatggtttgatggaagtaataaaaactatatagactccgtgaagggccgattcaccatctcaagagacaattccaagaacacgctgtatctgcaaatgaacagcctgagagccgaggacacggctgtgtattactgtgcgagagagggctatgattcggggactgattatatcccctatgatatttttgatatttggggccaagggacaatggtcaccgtctcttca

SEQ ID NO: 2004 - protein, 126 aa, Homo sapiens
QVQLVESGGGVVQPGRSLRLSCAASGFTFSNFGMHWVRQAPGKGLEWVAGIWFDGSNKNYIDSVKGRFTISRDNSKNTLYLQMNSLRAEDTAVYYCAREGYDSGTDYIPYDIFDIWGQGTMVTVSS

SEQ ID NO: 2005 - DNA, 24 bp, Homo sapiens
ggattcacctttagtaactttgga

SEQ ID NO: 2006 - protein, 8 aa, Homo sapiens
GFTFSNFG

SEQ ID NO: 2007 - DNA, 24 bp, Homo sapiens
atatggtttgatggaagtaataaa

SEQ ID NO: 2008 - protein, 8 aa, Homo sapiens
IWFDGSNK

SEQ ID NO: 2009 - DNA, 57 bp, Homo sapiens
gcgagagagggctatgattcggggactgattatatcccctatgatatttttgatatt

SEQ ID NO: 2010 - protein, 19 aa, Homo sapiens
AREGYDSGTDYIPYDIFDI

SEQ ID NO: 2011 - DNA, 363 bp, Homo sapiens
gaagtgcagctggtggagtctgggggaggcttggtacagcctggcacgtccctgagactctcctgtgcagcctctggattcacctttgatgattatgccatgcactgggtccggcaagctccagggaagggcctggagtgggtctcaggtattacttggaatagttataacatagactatgctgactctgtgaagggccgattcaccatctccagagacaacgccaagaactccctgtatctgcaaatgaacagtctgagagctgaggacacggccttgtattactgtgcaaaagatgatgactacagtaactacgtttactttgactactggggccagggaaccctggtcaccgtctcctca

SEQ ID NO: 2012 - protein, 121 aa, Homo sapiens
EVQLVESGGGLVQPGTSLRLSCAASGFTFDDYAMHWVRQAPGKGLEWVSGITWNSYNIDYADSVKGRFTISRDNAKNSLYLQMNSLRAEDTALYYCAKDDDYSNYVYFDYWGQGTLVTVSS

SEQ ID NO: 2013 - DNA, 24 bp, Homo sapiens
ggattcacctttgatgattatgcc

SEQ ID NO: 2014 - protein, 8 aa, Homo sapiens
GFTFDDYA

SEQ ID NO: 2015 - DNA, 24 bp, Homo sapiens
attacttggaatagttataacata

SEQ ID NO: 2016 - protein, 8 aa, Homo sapiens
ITWNSYNI

SEQ ID NO: 2017 - DNA, 42 bp, Homo sapiens
gcaaaagatgatgactacagtaactacgtttactttgactac

SEQ ID NO: 2018 - protein, 14 aa, Homo sapiens
AKDDDYSNYVYFDY

SEQ ID NO: 2019 - DNA, 360 bp, Homo sapiens
caggttcagctggtgcagtccggaactgaggtgaaggagcctggggcctcagtgaaggtctcctgtaaggcctctggttactcctttaccacctatggtatcagctggctgcgacaggcccctggacaaggacttgagtggatgggatggatcagcacttacaatggtgacacaatctctgcacagatgctccaggacagagtcaccctgaccgcagacacatccacgcgcacagcctacatggaactgagaagcctgagatctgacgacacggccgtgtattactgtgcgagaggtcatgagtatgatagtcttgtttattcttactggggccagggaaccctggtcaccgtctcctca

SEQ ID NO: 2020 - protein, 120 aa, Homo sapiens
QVQLVQSGTEVKEPGASVKVSCKASGYSFTTYGISWLRQAPGQGLEWMGWISTYNGDTISAQMLQDRVTLTADTSTRTAYMELRSLRSDDTAVYYCARGHEYDSLVYSYWGQGTLVTVSS

SEQ ID NO: 2021 - DNA, 24 bp, Homo sapiens
ggttactcctttaccacctatggt

SEQ ID NO: 2022 - protein, 8 aa, Homo sapiens
GYSFTTYG

SEQ ID NO: 2023 - DNA, 24 bp, Homo sapiens
atcagcacttacaatggtgacaca

SEQ ID NO: 2024 - protein, 8 aa, Homo sapiens
ISTYNGDT

SEQ ID NO: 2025 - DNA, 39 bp, Homo sapiens
gcgagaggtcatgagtatgatagtcttgtttattcttac

SEQ ID NO: 2026 - protein, 13 aa, Homo sapiens
ARGHEYDSLVYSY

SEQ ID NO: 2027 - DNA, 360 bp, Homo sapiens
caggtgcagctggtggagtctgggggaggcgtggtccagcctgggaggtccctgagactctcctgtgcagcgtctggattcaccttcagtagttatgccatgcactgggtccgccaggctccaggcagggggctggagtgggtggcggttatatggcatgatggagatgttgaatactatgtagactccgtgaaggaccgattcaccatctccagagacaattccaagagcacgctgtatctgcaaatgaacagcctgagagccgaagatacggctttatattattgtgcgagagaggcgtgggacctactacgtccctttgactattggggccagggaaccctggtcaccgtctcctca

SEQ ID NO: 2028 - protein, 120 aa, Homo sapiens
QVQLVESGGGVVQPGRSLRLSCAASGFTFSSYAMHWVRQAPGRGLEWVAVIWHDGDVEYYVDSVKDRFTISRDNSKSTLYLQMNSLRAEDTALYYCAREAWDLLRPFDYWGQGTLVTVSS

SEQ ID NO: 2029 - DNA, 24 bp, Homo sapiens
ggattcaccttcagtagttatgcc

SEQ ID NO: 2030 - protein, 8 aa, Homo sapiens
GFTFSSYA

SEQ ID NO: 2031 - DNA, 24 bp, Homo sapiens
atatggcatgatggagatgttgaa

SEQ ID NO: 2032 - protein, 8 aa, Homo sapiens
IWHDGDVE

SEQ ID NO: 2033 - DNA, 39 bp, Homo sapiens
gcgagagaggcgtgggacctactacgtccctttgactat

SEQ ID NO: 2034 - protein, 13 aa, Homo sapiens
AREAWDLLRPFDY

SEQ ID NO: 2035 - DNA, 351 bp, Homo sapiens
gaggtgcagctggtggagtctggaggaggcttggtccagcctggggggtccctgagactctcctgtgcagcctctgggttcatcgtcaccaccaactacatgacctggctccgccaggctccagggaaggggctggagtgggtctcacttatttatagcagtggtcacacatactacgcagactccgtgaagggccgattcaccatctccagacacaattccaagaacacactgtatctacaaatggacagcctgagagctgaggacacggccgtgtattactgtgcgagtgctttcgcagcggatgtttttgatatctggggccaagggacaatggtcaccgtctcttca

SEQ ID NO: 2036 - protein, 117 aa, Homo sapiens
EVQLVESGGGLVQPGGSLRLSCAASGFIVTTNYMTWLRQAPGKGLEWVSLIYSSGHTYYADSVKGRFTISRHNSKNTLYLQMDSLRAEDTAVYYCASAFAADVFDIWGQGTMVTVSS

SEQ ID NO: 2037 - DNA, 24 bp, Homo sapiens
gggttcatcgtcaccaccaactac

SEQ ID NO: 2038 - protein, 8 aa, Homo sapiens
GFIVTTNY

SEQ ID NO: 2039 - DNA, 21 bp, Homo sapiens
atttatagcagtggtcacaca

SEQ ID NO: 2040 - protein, 7 aa, Homo sapiens
IYSSGHT

SEQ ID NO: 2041 - DNA, 33 bp, Homo sapiens
gcgagtgctttcgcagcggatgtttttgatatc

SEQ ID NO: 2042 - protein, 11 aa, Homo sapiens
ASAFAADVFDI

SEQ ID NO: 2043 - DNA, 372 bp, Homo sapiens
caggtgcagctggtggagtctgggggaggcgtggtccagcctgggaggtccctgagactctcctgttcagcgtctggattctccttcagtcactttggcatgcactgggtccgccaggttccaggcgggggcctggagtgggtgacaagtatatggtttgatggaagtaatagatattatgcagactccttgaagggccgattcaccatctccagagacaattccaagaatactctgtatctggaaatgaacagcctgagagccgaggacacggctgtgtattactgtgtgagagaggggatactgggaactactaatccttatgatgtttttgatgtctggggtcaggggacaatggtcaccgtctcttca

SEQ ID NO: 2044 - protein, 124 aa, Homo sapiens
QVQLVESGGGVVQPGRSLRLSCSASGFSFSHFGMHWVRQVPGGGLEWVTSIWFDGSNRYYADSLKGRFTISRDNSKNTLYLEMNSLRAEDTAVYYCVREGILGTTNPYDVFDVWGQGTMVTVSS

SEQ ID NO: 2045 - DNA, 24 bp, Homo sapiens
ggattctccttcagtcactttggc

SEQ ID NO: 2046 - protein, 8 aa, Homo sapiens
GFSFSHFG

SEQ ID NO: 2047 - DNA, 24 bp, Homo sapiens
atatggtttgatggaagtaataga

SEQ ID NO: 2048 - protein, 8 aa, Homo sapiens
IWFDGSNR

SEQ ID NO: 2049 - DNA, 51 bp, Homo sapiens
gtgagagaggggatactgggaactactaatccttatgatgtttttgatgtc

SEQ ID NO: 2050 - protein, 17 aa, Homo sapiens
VREGILGTTNPYDVFDV

SEQ ID NO: 2051 - DNA, 372 bp, Homo sapiens
gaggtgcagctggtggagtctgggggaggcttggtacagccgggggggtccctgagactctcctgtgcagcctctggattcacctttagaagctatgtcatgagctggttccgccaggctccagggaaggggctggagtgggtctcaggaatgagtgggagtggtggaagcacatcctacgcagactccgtgaagggccggttcaccatctccagagacaattcaaagaatacgctgtatctgctaatgaacagcctgagaaccgaggacacggccgtatattattgtgcgaaagaaaacggggctaactggaactacggctactacggtatggacgtctggggccaagggaccacggtcaccgtctcctca

SEQ ID NO: 2052 - protein, 124 aa, Homo sapiens
EVQLVESGGGLVQPGGSLRLSCAASGFTFRSYVMSWFRQAPGKGLEWVSGMSGSGGSTSYADSVKGRFTISRDNSKNTLYLLMNSLRTEDTAVYYCAKENGANWNYGYYGMDVWGQGTTVTVSS

SEQ ID NO: 2053 - DNA, 24 bp, Homo sapiens
ggattcacctttagaagctatgtc

SEQ ID NO: 2054 - protein, 8 aa, Homo sapiens
GFTFRSYV

SEQ ID NO: 2055 - DNA, 24 bp, Homo sapiens
atgagtgggagtggtggaagcaca

SEQ ID NO: 2056 - protein, 8 aa, Homo sapiens
MSGSGGST

SEQ ID NO: 2057 - DNA, 51 bp, Homo sapiens
gcgaaagaaaacggggctaactggaactacggctactacggtatggacgtc

SEQ ID NO: 2058 - protein, 17 aa, Homo sapiens
AKENGANWNYGYYGMDV

SEQ ID NO: 2059 - DNA, 360 bp, Homo sapiens
caggtgcagctggtggagtctgggggaggcgtggtccagcctgggaggtccctgagactctcctgtgtagcgtctggattctccttcagtaactttggcatgcactgggtccgccaggctccaggcaaggggctggagtgggtggcaattatatggtatgatggaagtaataaatactattcagactccgtgaagggccgcttcaccatctccagagacaattccaagaacacgctgtatctgcaaatgaacagcctgagagtcgacgacacggctgtgtattactgtgcgagattcgatcgctggaaatttgacgcttttgatatctggggccaagggacaatggtcaccgtctcttca

SEQ ID NO: 2060 - protein, 120 aa, Homo sapiens
QVQLVESGGGVVQPGRSLRLSCVASGFSFSNFGMHWVRQAPGKGLEWVAIIWYDGSNKYYSDSVKGRFTISRDNSKNTLYLQMNSLRVDDTAVYYCARFDRWKFDAFDIWGQGTMVTVSS

SEQ ID NO: 2061 - DNA, 24 bp, Homo sapiens
ggattctccttcagtaactttggc

SEQ ID NO: 2062 - protein, 8 aa, Homo sapiens
GFSFSNFG

SEQ ID NO: 2063 - DNA, 24 bp, Homo sapiens
atatggtatgatggaagtaataaa

SEQ ID NO: 2064 - protein, 8 aa, Homo sapiens
IWYDGSNK

SEQ ID NO: 2065 - DNA, 39 bp, Homo sapiens
gcgagattcgatcgctggaaatttgacgcttttgatatc

SEQ ID NO: 2066 - protein, 13 aa, Homo sapiens
ARFDRWKFDAFDI

SEQ ID NO: 2067 - DNA, 360 bp, Homo sapiens
caggtgcagctggtggagtctgggggaggcgtggtccagcctgggaggtccctgagactctcctgtgcagcgtctggattcaccttcagtagctttgccatgcactgggtccgccaggctccaggcaaggggctggagtgggtggcagttatatggtatgatggaagtaatgattactatgcagcctccgtgaagggccgtttcaccatctccagagacaattccaagaacacgctgtatctggaaatgaacagactgagagccgaggacacggctgtgtatcactgtgcgagagataactggaattactgggggggtatggacgtctggggccaagggaccacggtcaccgtctcctca

SEQ ID NO: 2068 - protein, 120 aa, Homo sapiens
QVQLVESGGGVVQPGRSLRLSCAASGFTFSSFAMHWVRQAPGKGLEWVAVIWYDGSNDYYAASVKGRFTISRDNSKNTLYLEMNRLRAEDTAVYHCARDNWNYWGGMDVWGQGTTVTVSS

SEQ ID NO: 2069 - DNA, 24 bp, Homo sapiens
ggattcaccttcagtagctttgcc

SEQ ID NO: 2070 - protein, 8 aa, Homo sapiens
GFTFSSFA

SEQ ID NO: 2071 - DNA, 24 bp, Homo sapiens
atatggtatgatggaagtaatgat

SEQ ID NO: 2072 - protein, 8 aa, Homo sapiens
IWYDGSND

SEQ ID NO: 2073 - DNA, 39 bp, Homo sapiens
gcgagagataactggaattactgggggggtatggacgtc

SEQ ID NO: 2074 - protein, 13 aa, Homo sapiens
ARDNWNYWGGMDV

SEQ ID NO: 2075 - DNA, 375 bp, Homo sapiens
gaggtgcagctgttggagtctgggggaggctgggtgcagccgggggggtccctgagactctcctgtgcagcctctggattcgcctttagtaattatgccatgaactgggtccgccagactccagggaaggggctggagtgggtctcagttattagtagtagtggtggaaacacatactacgcagactccgtgaagggccggttcgccatctccagagacaattccagggatacgctgcatctgcaaatgaacagactgagagtcgaggacacggccgtctattactgtgcgaaagaaatacgtccgtattacgatctttcctactattacggtatggacgtctggggccaagggaccacggtcaccgtctcctca

SEQ ID NO: 2076 - protein, 125 aa, Homo sapiens
EVQLLESGGGWVQPGGSLRLSCAASGFAFSNYAMNWVRQTPGKGLEWVSVISSSGGNTYYADSVKGRFAISRDNSRDTLHLQMNRLRVEDTAVYYCAKEIRPYYDLSYYYGMDVWGQGTTVTVSS

SEQ ID NO: 2077 - DNA, 24 bp, Homo sapiens
ggattcgcctttagtaattatgcc

SEQ ID NO: 2078 - protein, 8 aa, Homo sapiens
GFAFSNYA

SEQ ID NO: 2079 - DNA, 24 bp, Homo sapiens
attagtagtagtggtggaaacaca

SEQ ID NO: 2080 - protein, 8 aa, Homo sapiens
ISSSGGNT

SEQ ID NO: 2081 - DNA, 54 bp, Homo sapiens
gcgaaagaaatacgtccgtattacgatctttcctactattacggtatggacgtc

SEQ ID NO: 2082 - protein, 18 aa, Homo sapiens
AKEIRPYYDLSYYYGMDV

SEQ ID NO: 2083 - DNA, 348 bp, Homo sapiens
caggtgcagctgcaggagtcgggcccaggactggtgaagtcttcggagaccctgtccctcacctgcactgtctctggtggctccatcagaaatttctactggagctggctccggcagcccccagggaagggactagagtggattgggcacatcaattacaatgggggcaccgactacaacccctccctcaagagtcgagtcaccatatcagtagacacgtccaagaatcagttctccctgaatttgaactctgtgaccgccgcagacacggccgtgtattactgtgcgagacagagattctacggtatggacgtctggggtccagggaccacggtcaccgtctcctca

SEQ ID NO: 2084 - protein, 116 aa, Homo sapiens
QVQLQESGPGLVKSSETLSLTCTVSGGSIRNFYWSWLRQPPGKGLEWIGHINYNGGTDYNPSLKSRVTISVDTSKNQFSLNLNSVTAADTAVYYCARQRFYGMDVWGPGTTVTVSS

SEQ ID NO: 2085 - DNA, 24 bp, Homo sapiens
ggtggctccatcagaaatttctac

SEQ ID NO: 2086 - protein, 8 aa, Homo sapiens
GGSIRNFY

SEQ ID NO: 2087 - DNA, 21 bp, Homo sapiens
atcaattacaatgggggcacc

SEQ ID NO: 2088 - protein, 7 aa, Homo sapiens
INYNGGT

SEQ ID NO: 2089 - DNA, 30 bp, Homo sapiens
gcgagacagagattctacggtatggacgtc

SEQ ID NO: 2090 - protein, 10 aa, Homo sapiens
ARQRFYGMDV

SEQ ID NO: 2091 - DNA, 324 bp, Homo sapiens; identical to SEQ ID NO: 57

SEQ ID NO: 2092 - protein, 108 aa, Homo sapiens; identical to SEQ ID NO: 58

SEQ ID NO: 2093 - DNA, 18 bp, Homo sapiens
cagagcattagcagctat

SEQ ID NO: 2094 - protein, 6 aa, Homo sapiens
QSISSY

SEQ ID NO: 2095 - DNA, 9 bp, Homo sapiens
gctgcatcc

SEQ ID NO: 2096 - protein, 3 aa, Homo sapiens
AAS

SEQ ID NO: 2097 - DNA, 30 bp, Homo sapiens; identical to SEQ ID NO: 15

SEQ ID NO: 2098 - protein, 10 aa, Homo sapiens
QQSYSTPPIT

SEQ ID NO: 2099 - protein, 1408 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 2100 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 2101 - protein, 934 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEVGFLHSSHDVNKEASVIMLFSGLK

SEQ ID NO: 2102 - protein, 281 aa, Homo sapiens
KEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKR

SEQ ID NO: 2103 - protein, 1101 aa, Homo sapiens
STKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 2104 - protein, 1082 aa, Homo sapiens
TKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 2105 - protein, 626 aa, Homo sapiens
TKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEVGFLHSSHDVNKEASVIMLFSGLK

SEQ ID NO: 2106 - protein, 650 aa, Artificial Sequence
  Description of Artificial Sequence: Synthetic polypeptide
TKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAEQKLISEEDLEQKLISEEDLHHHHHH

SEQ ID NO: 2107 - protein, 838 aa, Artificial Sequence
  Description of Artificial Sequence: Synthetic polypeptide
TKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAMEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKE

SEQ ID NO: 2108 - protein, 1100 aa, Artificial Sequence
  Description of Artificial Sequence: Synthetic polypeptide
STKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRAEFTTALQRVDLFMGQFSEVLLTSISTFVKGDLTIANLGTSEGRFMQVVVSRSGPSTPHVNFLLDSHPVSPEVIVEHPLNQNGYTLVVTGKKITKIPLNGLGCRHFQSCSQCLSAPPFVQCGWCHDKCVRSEECPSGTWTQQICLPAIYKVFPTSAPLEGGTRLTICGWDFGFRRNNKFDLKKTRVLLGNESCTLTLSESTMNTLKCTVGPAMNKHFNMSIIISNGHGTTQYSTFSYVDPIITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLHSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISIALLLLLGLFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTEQKLISEEDLEQKLISEEDLHHHHHH

SEQ ID NO: 2109 - protein, 936 aa, Homo sapiens
ECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTEQKLISEEDLGGEQKLISEEDLHHHHHH

SEQ ID NO: 2110 - protein, 13 aa, Homo sapiens
VRRLKETKDGFMF

SEQ ID NO: 2111 - protein, 11 aa, Homo sapiens
LARQIGASLND

SEQ ID NO: 2112 - protein, 35 aa, Homo sapiens
FIKGDLTIANLGTSEGRFMQVVVSRSGPSTPHVNF

SEQ ID NO: 2113 - protein, 4 aa, Artificial Sequence
  Description of Artificial Sequence: Synthetic peptide
GGGG

SEQ ID NO: 2114 - protein, 4 aa, Artificial Sequence
  Description of Artificial Sequence: Synthetic peptide
GGFG

What is claimed is:

1. A compound of Formula:

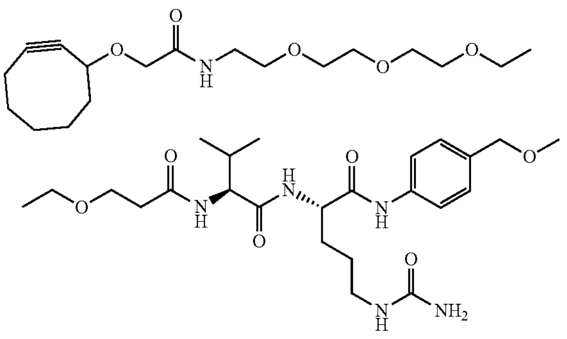

-continued

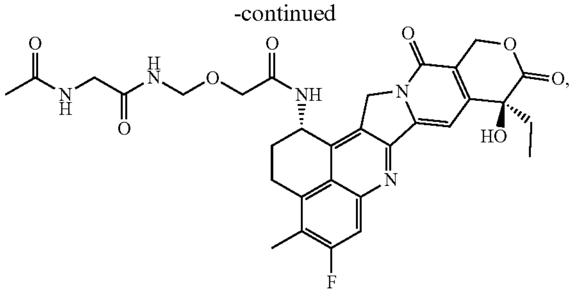

or a pharmaceutically acceptable salt thereof.

2. A compound having a structure according to Formula (P-I):
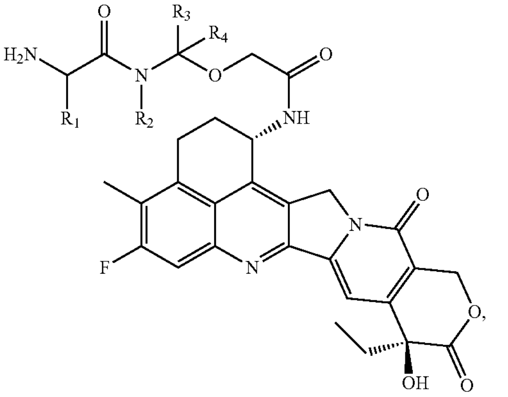
(P-I)
wherein $R_1$, $R_2$, $R_3$, and $R_4$ are independently a hydrogen or a $C_1$-$C_4$ alkyl, or wherein $R_2$ and $R_3$ form a 5-membered or a 6-membered ring,
or a pharmaceutically acceptable salt thereof, wherein the compound is not
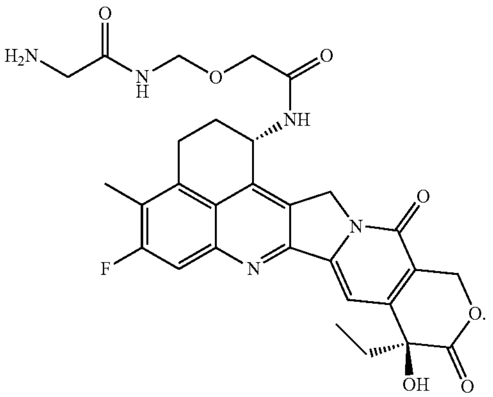 [SMILES: CC[C@@]1(O)C(=O)OCc2c1cc1n(c2=O)Cc2c-1nc1cc(F)c(C)c3c1c2[C@@H](NC(=O)COCNC(=O)CN)CC3]
* * * * *